United States Patent
Cowens et al.

(10) Patent No.: US 9,551,034 B2
(45) Date of Patent: Jan. 24, 2017

(54) METHOD TO USE GENE EXPRESSION TO DETERMINE LIKELIHOOD OF CLINICAL OUTCOME OF RENAL CANCER

(75) Inventors: Wayne Cowens, Tiburon, CA (US); Steven Shak, Hillsborough, CA (US); Audrey Goddard, San Francisco, CA (US); Dejan Knezevic, Palo Alto, CA (US); Joffre Baker, Montara, CA (US); Michael C. Kiefer, Clayton, CA (US); Tara Maddala, Sunnyvale, CA (US); Frederick L. Baehner, San Francisco, CA (US)

(73) Assignee: Genomic Health, Inc., Redwood City, CA (US)

(*) Notice: Subject to any disclaimer, the term of this patent is extended or adjusted under 35 U.S.C. 154(b) by 0 days.

(21) Appl. No.: 12/987,023

(22) Filed: Jan. 7, 2011

(65) Prior Publication Data

US 2011/0171633 A1    Jul. 14, 2011

Related U.S. Application Data

(60) Provisional application No. 61/294,038, filed on Jan. 11, 2010, provisional application No. 61/346,230, filed on May 19, 2010.

(51) Int. Cl.
*C12Q 1/68* (2006.01)
*G01N 33/574* (2006.01)

(52) U.S. Cl.
CPC ....... *C12Q 1/6886* (2013.01); *G01N 33/57438* (2013.01); *C12Q 2600/112* (2013.01); *C12Q 2600/118* (2013.01); *C12Q 2600/158* (2013.01)

(58) Field of Classification Search
None
See application file for complete search history.

(56) References Cited

U.S. PATENT DOCUMENTS

| | | | |
|---|---|---|---|
| 7,135,314 B1 | 11/2006 | Leung et al. | |
| 7,611,839 B2 | 11/2009 | Twine et al. | |
| 2002/0173461 A1* | 11/2002 | Pennica et al. | 514/12 |
| 2003/0180770 A1 | 9/2003 | Damokosh et al. | |
| 2003/0224374 A1 | 12/2003 | Dai et al. | |
| 2004/0088746 A1 | 5/2004 | Grimm et al. | |
| 2004/0110197 A1* | 6/2004 | Skinner | C12Q 1/6886 435/6.11 |
| 2005/0002904 A1* | 1/2005 | Wary | A01K 67/0271 424/93.2 |
| 2005/0048542 A1 | 3/2005 | Baker et al. | |
| 2006/0088823 A1 | 4/2006 | Haab et al. | |
| 2006/0183120 A1 | 8/2006 | Teh et al. | |
| 2006/0281122 A1 | 12/2006 | Bryant et al. | |
| 2007/0037186 A1* | 2/2007 | Jiang et al. | 435/6 |
| 2007/0099209 A1 | 5/2007 | Clarke et al. | |
| 2007/0105133 A1 | 5/2007 | Clarke et al. | |
| 2008/0032299 A1 | 2/2008 | Burczynski | |
| 2008/0064055 A1 | 3/2008 | Bryant et al. | |
| 2008/0182255 A1 | 7/2008 | Baker et al. | |
| 2008/0286273 A1 | 11/2008 | Starmans et al. | |
| 2009/0023149 A1 | 1/2009 | Knudsen | |
| 2009/0035312 A1 | 2/2009 | Griffioen et al. | |
| 2009/0186924 A1 | 7/2009 | Billen et al. | |
| 2009/0258002 A1 | 10/2009 | Barrett et al. | |
| 2010/0152055 A1 | 6/2010 | Kozono et al. | |

FOREIGN PATENT DOCUMENTS

| | | |
|---|---|---|
| JP | 2005211023 | 8/2005 |
| WO | WO 02079411 A2 * | 10/2002 |
| WO | WO2004048933 A2 | 6/2004 |
| WO | WO2004097052 A2 | 11/2004 |
| WO | WO 2005117943 A2 * | 12/2005 |
| WO | 2006/089185 A2 | 8/2006 |
| WO | 2006/124022 | 11/2006 |
| WO | WO2006124836 A1 | 11/2006 |
| WO | 2007/026896 A1 | 3/2007 |
| WO | WO2007072225 A2 | 6/2007 |
| WO | WO2008021115 A2 | 2/2008 |
| WO | WO2008138579 A1 | 11/2008 |
| WO | WO2009105640 A1 | 8/2009 |

OTHER PUBLICATIONS

Whitehead. Genome Biology. 2005. 6(2): Article R13.*
Anders. Molecular Carcninogenesis. 2011.*
Yao. Int. J. Cancer. 2008. 123: 1126-1132.*
Chan. G&P magazine. 2006. 6(3): 20-26.*
Hoshikawa. Physical Genomics. 2003. 12: 209-219. 2003.*
Sengupta. Cancer. 2005. 104: 511-520.*
Tan. Int. J. Cancer. 2008. 123: 1080-1088.*
Takahashi. PNAS. (2001) 98(17): 9754-9759, p. 9755.*
GenBank: AB385541.1 (Oct. 3, 2008).*
GenBank: AF043329.1 (Jan. 5, 1999).*
NCBI Reference Sequence: NM_003713.3 (Oct. 22, 2008).*
Hata et al. Immunology Letters. 2009. 126:29-36.*
Tomsig et al. Biochem. J. 2009. 419:611-618.*
Yang, et al. (2004) "Caffeine Suppresses Metastasis in a Transgenic Mouse Model: A Prototype Molecule for Prophylaxis of Metastasis" Clin. Exp. Metastasis 21(8):719-735.
De Kok et al., "Normalization of Gene Expression Measurements in Tumor Tissues: Comparison of 13 Endogenous Control Genes," *Laboratory Investigation* 85:154-159 (2005).
International Search Report and Written Opinion in PCT Application No. PCT/US2011/020596, 10 pages (mailed Nov. 25, 2011).
Search Report and Written Opinion for Singapore Patent Application No. 201204514-2 dated Jul. 29, 2013.
Zhao, H. at al., "Gene Expression Profiling Predicts Survival in Conventional Renal Cell Carcinoma", Plos Medicine, www.plosmedicine.org. 2006, vol. 3. Issue 1, e13. pp. 1-11.
Annual Meeting of the Japanese Cancer Association, 2006, vol. 65, pp. 367, P-888.
Unwin et al., "Proteomic changes in renal cancer and co-ordinate demonstration of both the glycolytic and mitochondrial aspects of the Warburg effect", Proteomics, 2003, vol. 3, pp. 1620-1632.
Partial European Search Report dated Apr. 11 2016; for European Application No. 15203193.6, 7 pages.
Extended European Search Report dated Jul. 28 2016, for European Application No. 15203193.6, 12 pages.

* cited by examiner

Primary Examiner — Joseph G Dauner
(74) Attorney, Agent, or Firm — McNeill Baur PLLC

(57) ABSTRACT

The present disclosure provides gene and gene sets, the expression of which is important in the classification and/or prognosis of cancer, in particular of renal cell carcinoma.

12 Claims, 9 Drawing Sheets

Performance of Mayo[1] Prognostic Tool Applied to CCF Data

"5-year recurrence-free risk" means proportion without recurrence at 5 years

Example of Using 1 Gene to Improve Prediction: EMCN in addition to Mayo Criteria (Leibovich et. al.)

- Cutpoint for EMCN derived by looking at quartiles of EMCN expression and their KM curves for RFI
- EMCN gives good separation beyond clinical/pathology covariates
- Similar results with other key genes named earlier

Example of Using 1 Gene to Improve Prediction: AQP1 in addition to Mayo Criteria (Leibovich et. al.)

Cutpoint for AQP1 derived by looking at quartiles of AQP1 expression and their KM curves for RFI

Example of Using 1 Gene to Improve Prediction: PPAP2B in addition to Mayo Criteria (Leibovich et. al.)

Cutpoint for PPAP2B derived by looking at quartiles of PPAP2B expression and their KM curves for RFI

METHOD TO USE GENE EXPRESSION TO DETERMINE LIKELIHOOD OF CLINICAL OUTCOME OF RENAL CANCER

CROSS-REFERENCE TO RELATED APPLICATIONS

The present application claims priority benefit of U.S. provisional application Ser. No. 61/294,038, filed Jan. 11, 2010 and priority benefit of U.S. provisional application Ser. No. 61/346,230, filed May 19, 2010, each of which applications are incorporated herein in their entireties.

TECHNICAL FIELD

The present disclosure relates to molecular diagnostic assays that provide information concerning prognosis in renal cancer patients.

INTRODUCTION

Each year in the United States there are approximately 51,000 cases of renal cell carcinoma (kidney cancer) and upper urinary tract cancer, resulting in more than 12,900 deaths. These tumors account for approximately 3% of adult malignancies. Renal cell carcinoma (RCC) represents about 3 percent of all cancers in the United States. Predictions for the United States for the year 2007 were that 40,000 new patients would be diagnosed with RCC and that 13,000 would die from this disease.

The clinical outcome for a renal cell carcinoma patient depends largely on the aggressiveness of their particular cancer. Surgical resection is the most common treatment for this disease as systemic therapy has demonstrated only limited effectiveness. However, approximately 30% of patients with localized tumors will experience a relapse following surgery, and only 40% of all patients with renal cell carcinoma survive for 5 years.

In the US, the number of adjuvant treatment decisions that will be made by patients with early stage renal cell carcinoma in 2005 exceeded 25,000. The rates in the European Union are expected to be similar. Physicians require prognostic information to help them make informed treatment decisions for patients with renal cell carcinoma and recruit appropriate high-risk patients for clinical trials. Surgeons must decide how much kidney and surrounding tissue to remove based, in part, on predicting the aggressiveness of a particular tumor. Today, cancer tumors are generally classified based on clinical and pathological features, such as stage, grade, and the presence of necrosis. These designations are made by applying standardized criteria, the subjectivity of which has been demonstrated by a lack of concordance amongst pathology laboratories.

SUMMARY

The present disclosure provides biomarkers, the expression of which has prognostic value in renal cancer.

DETAILED DESCRIPTION

Definitions

Figure 1A:
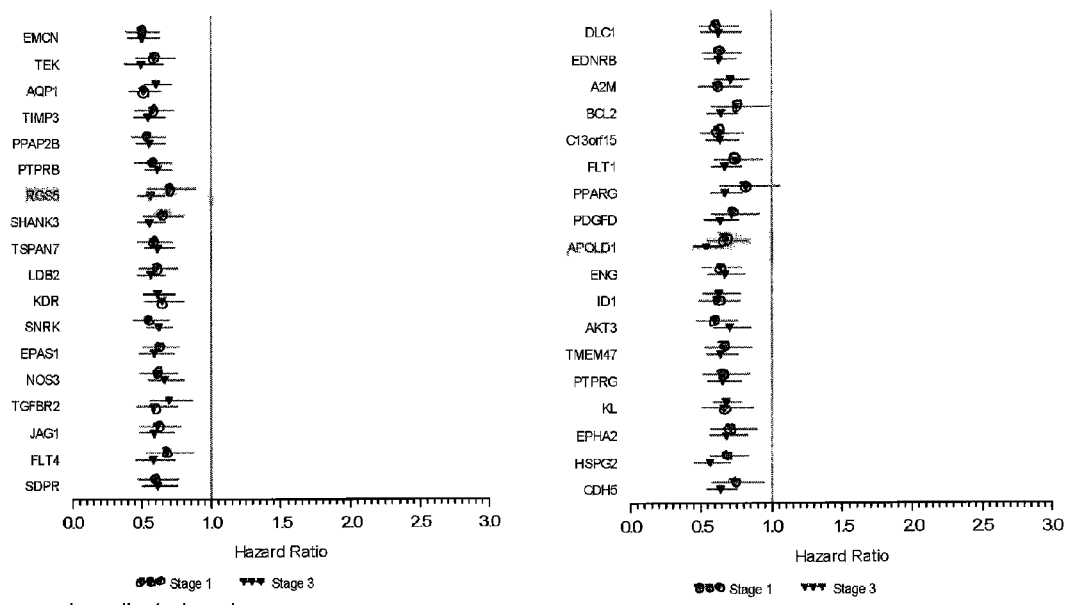
FIGS. 1a-1c: Consistency between Stage I and III for exemplary genes associated with RFI

Unless defined otherwise, technical and scientific terms used herein have the same meaning as commonly understood by one of ordinary skill in the art to which this invention belongs. Singleton et al., Dictionary of Microbiology and Molecular Biology 2nd ed., J. Wiley & Sons (New York, N.Y. 1994), and March, Advanced Organic Chemistry Reactions, Mechanisms and Structure 4th ed., John Wiley & Sons (New York, N.Y. 1992), provide one skilled in the art with a general guide to many of the terms used in the present application.

One skilled in the art will recognize many methods and materials similar or equivalent to those described herein, which could be used in the practice of the present invention. Indeed, the present invention is in no way limited to the methods and materials described. For purposes of the present invention, the following terms are defined below.

The term "tumor" is used herein to refer to all neoplastic cell growth and proliferation, and all pre-cancerous and cancerous cells and tissues. The term "primary tumor" is used herein to refer to a tumor that is at the original site where it first arose. For example, a primary renal cell carcinoma tumor is one that arose in the kidney. The term "metastatic tumor" is used herein to refer to a tumor that develops away from the site of origin. For example, renal cell carcinoma metastasis most commonly affects the spine, ribs, pelvis, and proximal long bones.

The terms "cancer" and "carcinoma" refer to or describe the physiological condition in mammals that is typically characterized by unregulated cell growth. The pathology of cancer includes, for example, abnormal or uncontrollable cell growth, metastasis, interference with the normal functioning of neighboring cells, release of cytokines or other secretory products at abnormal levels, suppression or aggravation of inflammatory or immunological response, neoplasia, premalignancy, malignancy, invasion of surrounding or distant tissues or organs, such as lymph nodes, blood vessels, etc.

As used herein, the terms "renal cancer" or "renal cell carcinoma" refer to cancer that has arisen from the kidney.

The terms "renal cell cancer" or "renal cell carcinoma" (RCC), as used herein, refer to cancer which originates in the lining of the proximal convoluted tubule. More specifically, RCC encompasses several relatively common histologic subtypes: clear cell renal cell carcinoma, papillary (chromophil), chromophobe, collecting duct carcinoma, and medullary carcinoma. Further information about renal cell carcinoma may be found in Y. Thyavihally, et al., *Int Semin Surg Oncol* 2:18 (2005), the contents of which are incorporated by reference herein. Clear cell renal cell carcinoma (ccRCC) is the most common subtype of RCC. Incidence of ccRCC is increasing, comprising 80% of localized disease and more than 90% of metastatic disease.

The staging system for renal cell carcinoma is based on the degree of tumor spread beyond the kidney. According to the tumor, node, metastasis (TNM) staging system of the American Joint Committee on Cancer (AJCC) (Greene, et al., AJCC Cancer Staging Manual, pp. 323-325 (6th Ed. 2002), the various stages of renal cell carcinoma are provided below. "Increased stage" as used herein refers to classification of a tumor at a stage that is more advanced, e.g., Stage 4 is an increased stage relative to Stages 1, 2, and 3.

Description of RCC Stages

Stages for Renal Cell Carcinoma

Stage 1: T1, N0, M0
Stage 2: T2, N0, M0
Stage 3: T1-T2, N1, M0; T3, N0-1, M0; T3a, N0-1, M0; T3b, N0-1, M0; and T3c, N0-1, M0
Stage 4: T4, N0-1, M0; Any T, N2, M0; and Any T, any N, M1
Primary tumor (T)

TX: Primary tumor cannot be assessed
T0: No evidence of primary tumor
T1: Tumor 7 cm or less in greatest dimension and limited to the kidney
T1a: Tumor 4 cm or less in greatest dimension and limited to the kidney
T1b: Tumor larger than 4 cm but 7 cm or less in greatest dimension and limited to the kidney
T2: Tumor larger than 7 cm in greatest dimension and limited to the kidney
T3: Tumor extends into major veins or invades adrenal gland or perinephric tissues but not beyond Gerota fascia
T3a: Tumor directly invades adrenal gland or perirenal and/or renal sinus fat but not beyond Gerota fascia
T3b: Tumor grossly extends into the renal vein or its segmental (i.e., muscle-containing) branches, or it extends into the vena cava below the diaphragm
T3c: Tumor grossly extends into the vena cava above the diaphragm or invades the wall of the vena cava
T4: Tumor invades beyond Gerota fascia
Regional lymph nodes (N)

NX: Regional lymph nodes cannot be assessed
N0: No regional lymph node metastasis
N1: Metastasis in a single regional lymph node
N2: Metastasis in more than one regional lymph node
Distant metastasis (M)

MX: Distant metastasis cannot be assessed
M0: No distant metastasis
M1: Distant metastasis The term "early stage renal cancer", as used herein, refers to Stages 1-3, as defined in the American Joint Committee on Cancer (AJCC) Cancer Staging Manual, pp. 323-325 (6th Ed. 2002).

Reference to tumor "grade" for renal cell carcinoma as used herein refers to a grading system based on microscopic appearance of tumor cells. According to the TNM staging system of the AJCC, the various grades of renal cell carcinoma are:
 GX (grade of differentiation cannot be assessed);
 G1 (well differentiated);
 G2 (moderately differentiated); and
 G3-G4 (poorly differentiated/undifferentiated).
"Increased grade" as used herein refers to classification of a tumor at a grade that is more advanced, e.g., Grade 4 (G4) 4 is an increased grade relative to Grades 1, 2, and 3. Tumor grading is an important prognostic factor in renal cell carcinoma. H. Rauschmeier, et al., World J Urol 2:103-108 (1984).

The terms "necrosis" or "histologic necrosis" as used herein refer to the death of living cells or tissues. The presence of necrosis may be a prognostic factor in cancer. For example, necrosis is commonly seen in renal cell carcinoma (RCC) and has been shown to be an adverse prognostic factor in certain RCC subtypes. V. Foria, et al., J Clin Pathol 58(1):39-43 (2005).

The terms "nodal invasion" or "node-positive (N+)" as used herein refer to the presence of cancer cells in one or more lymph nodes associated with the organ (e.g., drain the organ) containing a primary tumor. Nodal invasion is part of tumor staging for most cancers, including renal cell carcinoma.

The term "prognostic gene," when used in the single or plural, refers to a gene, the expression level of which is correlated with a good or bad prognosis for a cancer patient. A gene may be both a prognostic and predictive gene, depending on the association of the gene expression level with the corresponding endpoint.

The terms "correlated" and "associated" are used interchangeably herein to refer to the strength of association between two measurements (or measured entities). The disclosure provides genes and gene subsets, the expression levels of which are associated with a particular outcome measure, such as between the expression level of a gene and the likelihood of a recurrence event or relapse. For example, the increased expression level of a gene may be positively correlated (positively associated) with an increased likelihood of good clinical outcome for the patient, such as a decreased likelihood of recurrence of cancer. Such a positive correlation may be demonstrated statistically in various ways, e.g. by a hazard ratio less than 1.0. In another example, the increased expression level of a gene may be negatively correlated (negatively associated) with an increased likelihood of good clinical outcome for the patient. In that case, for example, a patient with a high expression level of a gene may have an increased likelihood of recurrence of the cancer. Such a negative correlation could indicate that the patient with a high expression level of a gene likely has a poor prognosis, or might respond poorly to a chemotherapy, and this may be demonstrated statistically in various ways, e.g., a hazard ratio greater than 1.0.

"Co-expression" is used herein to refer to strength of association between the expression levels of two different genes that are biologically similar, such that expression level of a first gene may be substituted with an expression level of a second gene in a given analysis in view of their correlation of expression. Such co-expressed genes (or correlated expression) indicates that these two genes are substitutable in an expression algorithm, for example, if a first gene is highly correlated, positively or negatively, with increased likelihood of a good clinical outcome for renal cell carcinoma, then the second co-expressed gene also correlates, in the same direction as the first gene, with the same outcome. Pairwise co-expression may be calculated by various methods known in the art, e.g., by calculating Pearson correlation coefficients or Spearman correlation coefficients or by clustering methods. The methods described herein may incorporate one or more genes that co-express, with a Pearson correlation co-efficient of at least 0.5. Co-expressed gene cliques may also be identified using graph theory. An analysis of co-expression may be calculated using normalized or standardized and normalized expression data.

The terms "prognosis" and "clinical outcome" are used interchangeably herein to refer to an estimate of the likelihood of cancer-attributable death or progression, including recurrence, and metastatic spread of a neoplastic disease, such as renal cell carcinoma. The terms "good prognosis" or "positive clinical outcome" mean a desired clinical outcome. For example, in the context of renal cell carcinoma, a good prognosis may be an expectation of no local recurrences or metastasis within two, three, four, five or more years of the initial diagnosis of renal cell carcinoma. The terms "poor prognosis" or "negative clinical outcome" are used herein interchangeably to mean an undesired clinical outcome. For example, in the context of renal cell carcinoma, a poor prognosis may be an expectation of a local recurrence or metastasis within two, three, four, five or more years of the initial diagnosis of renal cell carcinoma.

The term "predictive gene" is used herein to refer to a gene, the expression of which is correlated, positively or negatively, with likelihood of beneficial response to treatment.

A "clinical outcome" can be assessed using any endpoint, including, without limitation, (1) aggressiveness of tumor growth (e.g., movement to higher stage); (2) metastasis; (3) local recurrence; (4) increase in the length of survival following treatment; and/or (5) decreased mortality at a given point of time following treatment. Clinical response may also be expressed in terms of various measures of clinical outcome. Clinical outcome can also be considered in the context of an individual's outcome relative to an outcome of a population of patients having a comparable clinical diagnosis, and can be assessed using various endpoints such as an increase in the duration of Recurrence-Free interval (RFI), an increase in the duration of Overall Survival (OS) in a population, an increase in the duration of Disease-Free Survival (DFS), an increase in the duration of Distant Recurrence-Free Interval (DRFI), and the like.

The term "treatment", as used herein, refers to therapeutic compounds administered to patients to cease or reduce proliferation of cancer cells, shrink the tumor, avoid progression and metastasis, or cause primary tumor or metastases regression. Examples of treatment include, for example, cytokine therapy, progestational agents, anti-angiogenic therapy, hormonal therapy, and chemotherapy (including small molecules and biologics).

The terms "surgery" or "surgical resection" are used herein to refer to surgical removal of some or all of a tumor, and usually some of the surrounding tissue. Examples of surgical techniques include laproscopic procedures, biopsy, or tumor ablation, such as cryotherapy, radio frequency ablation, and high intensity ultrasound. In cancer patients, the extent of tissue removed during surgery depends on the state of the tumor as observed by a surgeon. For example, a partial nephrectomy indicates that part of one kidney is removed; a simple nephrectomy entails removal of all of one kidney; a radical nephrectomy, all of one kidney and neighboring tissue (e.g., adrenal gland, lymph nodes) removed; and bilateral nephrectomy, both kidneys removed.

The terms "recurrence" and "relapse" are used herein, in the context of potential clinical outcomes of cancer, to refer to a local or distant metastases. Identification of a recurrence could be done by, for example, CT imaging, ultrasound, arteriogram, or X-ray, biopsy, urine or blood test, physical exam, or research center tumor registry.

The term "recurrence-free interval" as used herein refers to the time from surgery to first recurrence or death due to recurrence of renal cancer. Losses to follow-up, second primary cancers, other primary cancers, and deaths prior to recurrence are considered censoring events.

The term "overall survival" is defined as the time from surgery to death from any cause. Losses to follow-up are considered censoring events. Recurrences are ignored for the purposes of calculating overall survival (OS).

The term "disease-free survival" is defined as the time from surgery to first recurrence or death from any cause, whichever occurs first. Losses to follow-up are considered censoring events.

The term "Hazard Ratio (HR)" as used herein refers to the effect of an explanatory variable on the hazard or risk of an event (i.e. recurrence or death). In proportional hazards regression models, the HR is the ratio of the predicted hazard for two groups (e.g. patients with or without necrosis) or for a unit change in a continuous variable (e.g. one standard deviation change in gene expression).

The term "Odds Ratio (OR)" as used herein refers to the effect of an explanatory variable on the odds of an event (e.g. presence of necrosis). In logistic regression models, the OR is the ratio of the predicted odds for a unit change in a continuous variable (e.g. one standard deviation change in gene expression).

The term "prognostic clinical and/or pathologic covariate" as used herein refers to clinical and/or prognostic covariates that are significantly associated ($p \leq 0.05$) with clinical outcome. For example, prognostic clinical and pathologic covariates in renal cell carcinoma include tumor stage (e.g. size, nodal invasion, etc.), and grade (e.g., Fuhrman grade), histologic necrosis, and gender.

The term "proxy gene" refers to a gene, the expression of which is correlated (positively or negatively) with one or more prognostic clinical and/or pathologic covariates. The expression level(s) of one or more proxy genes may be used instead of, or in addition to, classification of a tumor by physical or mechanical examination in a pathology laboratory.

The term "microarray" refers to an ordered arrangement of hybridizable array elements, preferably polynucleotide probes, on a substrate.

The term "polynucleotide," when used in singular or plural, generally refers to any polyribonucleotide or polydeoxribonucleotide, which may be unmodified RNA or DNA or modified RNA or DNA. Thus, for instance, polynucleotides as defined herein include, without limitation, single- and double-stranded DNA, DNA including single- and double-stranded regions, single- and double-stranded RNA, and RNA including single- and double-stranded regions, hybrid molecules comprising DNA and RNA that may be single-stranded or, more typically, double-stranded or include single- and double-stranded regions. In addition, the term "polynucleotide" as used herein refers to triple-stranded regions comprising RNA or DNA or both RNA and DNA. The strands in such regions may be from the same molecule or from different molecules. The regions may include all of one or more of the molecules, but more typically involve only a region of some of the molecules. One of the molecules of a triple-helical region often is an oligonucleotide. The term "polynucleotide" specifically includes DNAs (e.g., cDNAs) and RNAs that contain one or more modified bases. Thus, DNAs or RNAs with backbones modified for stability or for other reasons are "polynucleotides" as that term is intended herein. Moreover, DNAs or RNAs comprising unusual bases, such as inosine, or modified bases, such as tritiated bases, are included within the term "polynucleotides" as defined herein. In general, the term "polynucleotide" embraces all chemically, enzymatically and/or metabolically modified forms of unmodified polynucleotides, as well as the chemical forms of DNA and RNA characteristic of viruses and cells, including simple and complex cells.

The term "oligonucleotide" refers to a relatively short polynucleotide, including, without limitation, single-stranded deoxyribonucleotides, single- or double-stranded ribonucleotides, RNA:DNA hybrids and double-stranded DNAs. Oligonucleotides, such as single-stranded DNA probe oligonucleotides, are often synthesized by chemical methods, for example using automated oligonucleotide synthesizers that are commercially available. However, oligonucleotides can be made by a variety of other methods, including in vitro recombinant DNA-mediated techniques and by expression of DNAs in cells and organisms.

The term "expression level" as applied to a gene refers to the normalized level of a gene product.

The terms "gene product" or "expression product" are used herein interchangeably to refer to the RNA transcription products (RNA transcript) of a gene, including mRNA, and the polypeptide translation product of such RNA transcripts. A gene product can be, for example, an unspliced RNA, an mRNA, a splice variant mRNA, a microRNA, a fragmented RNA, a polypeptide, a post-translationally modified polypeptide, a splice variant polypeptide, etc.

"Stringency" of hybridization reactions is readily determinable by one of ordinary skill in the art, and generally is an empirical calculation dependent upon probe length, washing temperature, and salt concentration. In general, longer probes require higher temperatures for proper annealing, while shorter probes need lower temperatures. Hybridization generally depends on the ability of denatured DNA to re-anneal when complementary strands are present in an environment below their melting temperature. The higher the degree of desired homology between the probe and hybridizable sequence, the higher the relative temperature that can be used. As a result, it follows that higher relative temperatures would tend to make the reaction conditions more stringent, while lower temperatures less so. For additional details and explanation of stringency of hybridization reactions, see Ausubel et al., *Current Protocols in Molecular Biology*, (Wiley Interscience, 1995).

"Stringent conditions" or "high stringency conditions", as defined herein, typically: (1) employ low ionic strength solutions and high temperature for washing, for example 0.015 M sodium chloride/0.0015 M sodium citrate/0.1% sodium dodecyl sulfate at 50° C.; (2) employ during hybridization a denaturing agent, such as formamide, for example, 50% (v/v) formamide with 0.1% bovine serum albumin/0.1% Ficoll/0.1% polyvinylpyrrolidone/50 mM sodium phosphate buffer at pH 6.5 with 750 mM sodium chloride, 75 mM sodium citrate at 42° C.; or (3) employ 50% formamide, 5×SSC (0.75 M NaCl, 0.075 M sodium citrate), 50 mM sodium phosphate (pH 6.8), 0.1% sodium pyrophosphate, 5×Denhardt's solution, sonicated salmon sperm DNA (50 μg/ml), 0.1% SDS, and 10% dextran sulfate at 42° C., with washes at 42° C. in 0.2×SSC (sodium chloride/sodium citrate) and 50% formamide at 55° C., followed by a high-stringency wash consisting of 0.1×SSC containing EDTA at 55° C.

"Moderately stringent conditions" may be identified as described by Sambrook et al., *Molecular Cloning: A Laboratory Manual* (Cold Spring Harbor Press, 1989), and include the use of washing solution and hybridization conditions (e.g., temperature, ionic strength and % SDS) less stringent that those described above. An example of moderately stringent condition is overnight incubation at 37° C. in a solution comprising: 20% formamide, 5×SSC (150 mM NaCl, 15 mM trisodium citrate), 50 mM sodium phosphate (pH 7.6), 5×Denhardt's solution, 10% dextran sulfate, and 20 mg/ml denatured sheared salmon sperm DNA, followed by washing the filters in 1×SSC at about 37-50° C. The skilled artisan will recognize how to adjust the temperature, ionic strength, etc. as necessary to accommodate factors such as probe length and the like.

In the context of the present invention, reference to "at least one," "at least two," "at least five," etc. of the genes listed in any particular gene set means any one or any and all combinations of the genes listed.

The terms "splicing" and "RNA splicing" are used interchangeably and refer to RNA processing that removes introns and joins exons to produce mature mRNA with continuous coding sequence that moves into the cytoplasm of an eukaryotic cell.

In theory, the term "exon" refers to any segment of an interrupted gene that is represented in a mature RNA product (B. Lewin, *Genes IV* (Cell Press, 1990)). In theory the term "intron" refers to any segment of DNA that is transcribed but removed from within the transcript by splicing together the exons on either side of it. Operationally, exon sequences occur in the mRNA sequence of a gene as defined by Ref. SEQ ID numbers. Operationally, intron sequences are the intervening sequences within the genomic DNA of a gene, bracketed by exon sequences and usually having GT and AG splice consensus sequences at their 5' and 3' boundaries.

A "computer-based system" refers to a system of hardware, software, and data storage medium used to analyze information. The minimum hardware of a patient computer-based system comprises a central processing unit (CPU), and hardware for data input, data output (e.g., display), and data storage. An ordinarily skilled artisan can readily appreciate that any currently available computer-based systems and/or components thereof are suitable for use in connection with the methods of the present disclosure. The data storage medium may comprise any manufacture comprising a recording of the present information as described above, or a memory access device that can access such a manufacture.

To "record" data, programming or other information on a computer readable medium refers to a process for storing information, using any such methods as known in the art. Any convenient data storage structure may be chosen, based on the means used to access the stored information. A variety of data processor programs and formats can be used for storage, e.g. word processing text file, database format, etc.

A "processor" or "computing means" references any hardware and/or software combination that will perform the functions required of it. For example, a suitable processor may be a programmable digital microprocessor such as available in the form of an electronic controller, mainframe, server or personal computer (desktop or portable). Where the processor is programmable, suitable programming can be communicated from a remote location to the processor, or previously saved in a computer program product (such as a portable or fixed computer readable storage medium, whether magnetic, optical or solid state device based). For example, a magnetic medium or optical disk may carry the programming, and can be read by a suitable reader communicating with each processor at its corresponding station.

The present disclosure provides methods for assessing a patient's risk of recurrence of cancer, which methods comprise assaying an expression level of at least one gene, or its gene product, in a biological sample obtained from the patient. In some embodiments, the biological sample can be a tumor sample obtained from the kidney, or surrounding tissues, of the patient. In other embodiments, the biological sample is obtained from a bodily fluid, such as blood or urine.

The present disclosure provides genes useful in the methods disclosed herein. The genes are listed in Tables 3a and 3b, wherein increased expression of genes listed in Table 3a is significantly associated with a lower risk of cancer recurrence, and increased expression of genes listed in Table 3b is significantly associated with a higher risk of cancer recurrence. In some embodiments, a co-expressed gene may be used in conjunction with, or substituted for, a gene listed in Tables 3a or 3b with which it co-expresses.

The present disclosure further provides genes significantly associated, positively or negatively, with renal cancer recurrence after adjusting for clinical/pathologic covariates (stage, tumor grade, tumor size, nodal status, and presence of necrosis). For example, Table 8a lists genes wherein increased expression is significantly associated with lower risk of renal cancer recurrence after adjusting for clinical/pathologic covariates, and Table 8b lists genes wherein increased expression is significantly associated with a higher risk of renal cancer recurrence after adjusting for clinical/pathologic covariates. Of those genes listed in Tables 8a and 8b, 16 genes with significant association, positively or negatively, with good prognosis after adjusting for clinical/pathologic covariates and controlling the false discovery rate at 10% are listed in Table 9. One or more of these genes may be used separately, or in addition to, at least one of the genes listed in Tables 3a and 3b, to provide information concerning a patient's prognosis.

The present disclosure also provides proxy genes that are useful for assessing the status of clinical and/or pathologic covariates for a cancer patient. Proxy genes for tumor stage are listed in Tables 4a and 4b, wherein increased expression of genes listed in Table 4a is significantly associated with higher tumor stage, and increased expression of genes listed in Table 4b is significantly associated with lower tumor stage. Proxy genes for tumor grade are listed in Tables 5a and 5b wherein increased expression of genes listed in Table 5a is significantly associated with higher tumor grade, and increased expression of genes listed in Table 5b is significantly associated with lower tumor grade. Proxy genes for the presence of necrosis are listed in Tables 6a and 6b, wherein expression of genes listed in Table 6a is significantly associated with the presence of necrosis, and increased expression of genes listed in Table 6b is significantly associated with the absence of necrosis. Proxy genes for nodal involvement are listed in Tables 7a and 7b wherein higher expression of genes listed in Table 7a are significantly associated with the presence of nodal invasion, and increased expression of genes listed in Table 7b are significantly associated with the absence of nodal invasion. One or more proxy genes may be used separately, or in addition to, at least one of the genes listed in Tables 3a and 3b, to provide information concerning a patient's prognosis. In some embodiments, at least two of the following proxy genes are used to provide information concerning the patient's prognosis: TSPAN7, TEK, LDB2, TIMP3, SHANK3, RGS5, KDR, SDPR, EPAS1, ID1, TGFBR2, FLT4, SDPR, ENDRB, JAG1, DLC1, and KL. In some embodiments, a co-expressed gene may be used in conjunction with, or substituted for, a proxy gene with which it co-expresses.

The present disclosure also provides sets of genes in biological pathways that are useful for assessing the likelihood that a cancer patient is likely to have a positive clinical outcome, which sets of genes are referred to herein as "gene subsets". The gene subsets include angiogenesis, immune response, cell adhesion/extracellular matrix, cell cycle, transport, and apoptosis. In some embodiments, the angiogenesis gene subset includes ADD1, ANGPTL3, APOLD1, CEACAM1, EDNRB, EMCN, ENG, EPAS1, FLT1, JAG1, KDR, KL, LDB2, NOS3, NUDT6, PPAP2B, PRKCH, PTPRB, RGS5, SHANK3, SNRK, TEK, ICAM2, and VCAM1; the immune response gene subset includes CCL5, CCR7, CD8A, CX3CL1, CXCL10, CXCL9, HLA-DPB1, IL6, IL8, and SPP1, and; the transport gene subset includes AQP1 and SGK1; the cell adhesion/extracellular matrix gene subset includes ITGB1, A2M, ITGB5, LAMB1, LOX, MMP14, TGFBR2, TIMP3, and TSPAN7; the cell cycle gene subset includes BUB1, C13orf15, CCNB1, PTTG1, TPX2, LMNB1, and TUBB2A; the apoptosis gene subset includes CASP10; the early response gene subset includes EGR1 and CYR61; the metabolic signaling gene subset includes CA12, ENO2, UGCG, and SDPR; and the signaling gene subset includes ID1 and MAP2K3.

The present disclosure also provides genes in biological pathways targeted by chemotherapy that are correlated, positively or negatively, to a risk of cancer recurrence. These genes include KIT, PDGFA, PDGFB, PDGFC, PDGFD, PDGFRb, KRAS, RAF1, MTOR, HIF1AN, VEGFA, VEGFB, and FLT4. In some embodiments, the chemotherapy is cytokine and/or anti-angiogenic therapy. In other embodiments, the chemotherapy is sunitinib, sorafenib, temsirolimus, bevacizumab, everolimus, and/or pazopanib.

In some embodiments, a co-expressed gene may be used in conjunction with, or substituted for, a gene with which it co-expresses.

In some embodiments, the cancer is renal cell carcinoma. In other embodiments, the cancer is clear cell renal cell carcinoma (ccRCC), papillary, chromophobe, collecting duct carcinoma, and/or medullary carcinoma.

Various technological approaches for determination of expression levels of the disclosed genes are set forth in this specification, including, without limitation, reverse-transciption polymerase chain reaction (RT-PCR), microarrays, high-throughput sequencing, serial analysis of gene expression (SAGE), and Digital Gene Expression (DGE), which will be discussed in detail below. In particular aspects, the expression level of each gene may be determined in relation to various features of the expression products of the gene, including exons, introns, protein epitopes, and protein activity.

The expression levels of genes identified herein may be measured in tumor tissue. For example, the tumor tissue may be obtained upon surgical resection of the tumor, or by tumor biopsy. The expression level of the identified genes may also be measured in tumor cells recovered from sites distant from the tumor, including circulating tumor cells or body fluid (e.g., urine, blood, blood fraction, etc.).

The expression product that is assayed can be, for example, RNA or a polypeptide. The expression product may be fragmented. For example, the assay may use primers that are complementary to target sequences of an expression product and could thus measure full transcripts as well as those fragmented expression products containing the target sequence. Further information is provided in Tables A and B, which provide examples of sequences of forward primers, reverse primers, probes and amplicons generated by use of the primers.

The RNA expression product may be assayed directly or by detection of a cDNA product resulting from a PCR-based amplification method, e.g., quantitative reverse transcription polymerase chain reaction (qRT-PCR). (See e.g., U.S. Pub. No. US2006-0008809A1.) Polypeptide expression product may be assayed using immunohistochemistry (IHC). Further, both RNA and polypeptide expression products may also be is assayed using microarrays.

Clinical Utility

Currently, of the expected clinical outcome for RCC patients is based on subjective determinations of a tumor's clinical and pathologic features. For example, physicians make decisions about the appropriate surgical procedures and adjuvant therapy based on a renal tumor's stage, grade, and the presence of necrosis. Although there are standardized measures to guide pathologists in making these decisions, the level of concordance between pathology laboratories is low. (See Al-Ayanti M et al. (2003) Arch Pathol Lab Med 127, 593-596) It would be useful to have a reproducible molecular assay for determining and/or confirming these tumor characteristics.

In addition, standard clinical criteria, by themselves, have limited ability to accurately estimate a patient's prognosis. It would be useful to have a reproducible molecular assay to assess a patient's prognosis based on the biology of his or her tumor. Such information could be used for the purposes of patient counseling, selecting patients for clinical trials (e.g., adjuvant trials), and understanding the biology of renal cell carcinoma. In addition, such a test would assist physicians in making surgical and treatment recommendations based on the biology of each patient's tumor. For example, a genomic test could stratify RCC patients based on risk of recurrence and/or likelihood of long-term survival without recurrence (relapse, metastasis, etc.). There are several ongoing and planned clinical trials for RCC therapies, including adjuvant radiation and chemotherapies. It would be useful to have a genomic test able to identify high-risk patients more accurately than standard clinical criteria, thereby further enriching an adjuvant RCC population for study. This would reduce the number of patients needed for an adjuvant trial and the time needed for definitive testing of these new agents in the adjuvant setting.

Finally, it would be useful to have a molecular assay that could predict a patient's likelihood to respond to treatment, such as chemotherapy. Again, this would facilitate individual treatment decisions and recruiting patients for clinical trials, and increase physician and patient confidence in making healthcare decisions after being diagnosed with cancer.

Reporting Results

The methods of the present disclosure are suited for the preparation of reports summarizing the expected clinical outcome resulting from the methods of the present disclosure. A "report," as described herein, is an electronic or tangible document that includes report elements that provide information of interest relating to a likelihood assessment and its results. A subject report includes at least a likelihood assessment, e.g., an indication as to the risk of recurrence for a subject with renal cell carcinoma. A subject report can be completely or partially electronically generated, e.g., presented on an electronic display (e.g., computer monitor). A report can further include one or more of: 1) information regarding the testing facility; 2) service provider information; 3) patient data; 4) sample data; 5) an interpretive report, which can include various information including: a) indication; b) test data, where test data can include a normalized level of one or more genes of interest, and 6) other features.

The present disclosure thus provides for methods of creating reports and the reports resulting therefrom. The report may include a summary of the expression levels of the RNA transcripts, or the expression products of such RNA transcripts, for certain genes in the cells obtained from the patient's tumor. The report can include information relating to prognostic covariates of the patient. The report may include an estimate that the patient has an increased risk of recurrence. That estimate may be in the form of a score or patient stratifier scheme (e.g., low, intermediate, or high risk of recurrence). The report may include information relevant to assist with decisions about the appropriate surgery (e.g., partial or total nephrectomy) or treatment for the patient.

Thus, in some embodiments, the methods of the present disclosure further include generating a report that includes information regarding the patient's likely clinical outcome, e.g. risk of recurrence. For example, the methods disclosed herein can further include a step of generating or outputting a report providing the results of a subject risk assessment, which report can be provided in the form of an electronic medium (e.g., an electronic display on a computer monitor), or in the form of a tangible medium (e.g., a report printed on paper or other tangible medium).

A report that includes information regarding the patient's likely prognosis (e.g., the likelihood that a patient having renal cell carcinoma will have a good prognosis or positive clinical outcome in response to surgery and/or treatment) is provided to a user. An assessment as to the likelihood is referred to below as a "risk report" or, simply, "risk score." A person or entity that prepares a report ("report generator") may also perform the likelihood assessment. The report generator may also perform one or more of sample gathering, sample processing, and data generation, e.g., the report generator may also perform one or more of: a) sample gathering; b) sample processing; c) measuring a level of a risk gene; d) measuring a level of a reference gene; and e) determining a normalized level of a risk gene. Alternatively, an entity other than the report generator can perform one or more sample gathering, sample processing, and data generation.

For clarity, it should be noted that the term "user," which is used interchangeably with "client," is meant to refer to a person or entity to whom a report is transmitted, and may be the same person or entity who does one or more of the following: a) collects a sample; b) processes a sample; c) provides a sample or a processed sample; and d) generates data (e.g., level of a risk gene; level of a reference gene product(s); normalized level of a risk gene for use in the likelihood assessment. In some cases, the person(s) or entity(ies) who provides sample collection and/or sample processing and/or data generation, and the person who receives the results and/or report may be different persons, but are both referred to as "users" or "clients" herein to avoid confusion. In certain embodiments, e.g., where the methods are completely executed on a single computer, the user or client provides for data input and review of data output. A "user" can be a health professional (e.g., a clinician, a laboratory technician, a physician (e.g., an oncologist, surgeon, pathologist), etc.).

In embodiments where the user only executes a portion of the method, the individual who, after computerized data processing according to the methods of the present disclosure, reviews data output (e.g., results prior to release to provide a complete report, a complete, or reviews an "incomplete" report and provides for manual intervention and completion of an interpretive report) is referred to herein as a "reviewer." The reviewer may be located at a location remote to the user (e.g., at a service provided separate from a healthcare facility where a user may be located).

Where government regulations or other restrictions apply (e.g., requirements by health, malpractice, or liability insur-

Methods of Assaying Expression Levels of a Gene Product

Numerous assay methods for measuring an expression level of a gene product are known in the art, including assay methods for measuring an expression level of a nucleic acid gene product (e.g., an mRNA), and assay methods for measuring an expression level of a polypeptide gene product.

Measuring a Level of a Nucleic Acid Gene Product

In general, methods of measuring a level of a nucleic acid gene product (e.g., an mRNA) include methods involving hybridization analysis of polynucleotides, and methods involving amplification of polynucleotides. Commonly used methods known in the art for the quantification of mRNA expression in a sample include northern blotting and in situ hybridization (See for example, Parker & Barnes, *Methods in Molecular Biology* 106:247-283 (1999)); RNAse protection assays (Hod, *Biotechniques* 13:852-854 (1992)); and reverse transcription polymerase chain reaction (RT-PCR) (Weis et al., *Trends in Genetics* 8:263-264 (1992)). Alternatively, antibodies may be employed that can recognize specific duplexes, including DNA duplexes, RNA duplexes, and DNA-RNA hybrid duplexes or DNA-protein duplexes. Representative methods for sequencing-based gene expression analysis include Serial Analysis of Gene Expression (SAGE), and gene expression analysis by massively parallel signature sequencing (MPSS).

Expression Methods Based on Hybridization

The level of a target nucleic acid can be measured using a probe that hybridizes to the target nucleic acid. The target nucleic acid could be, for example, a RNA expression product of a response indicator gene associated with response to a VEGF/VEGFR Inhibitor, or a RNA expression product of a reference gene. In some embodiments, the target nucleic acid is first amplified, for example using a polymerase chain reaction (PCR) method.

A number of methods are available for analyzing nucleic acid mixtures for the presence and/or level of a specific nucleic acid. mRNA may be assayed directly or reverse transcribed into cDNA for analysis.

In some embodiments, the method involves contacting a sample (e.g., a sample derived from a cancer cell) under stringent hybridization conditions with a nucleic acid probe and detecting binding, if any, of the probe to a nucleic acid in the sample. A variety of nucleic acid hybridization methods are well known to those skilled in the art, and any known method can be used. In some embodiments, the nucleic acid probe will be detectably labeled.

Expression Methods Based on Target Amplification

Methods of amplifying (e.g., by PCR) nucleic acid, methods of performing primers extension, and methods of assessing nucleic acids are generally well known in the art. (See e.g., Ausubel, et al, Short Protocols in Molecular Biology, 3rd ed., Wiley & Sons, 1995 and Sambrook, et al, Molecular Cloning: A Laboratory Manual, Third Edition, (2001) Cold Spring Harbor, N.Y.)

A target mRNA can be amplified by reverse transcribing the mRNA into cDNA, and then performing PCR (reverse transcription-PCR or RT-PCR). Alternatively, a single enzyme may be used for both steps as described in U.S. Pat. No. 5,322,770.

The fluorogenic 5' nuclease assay, known as the Taq-Man® assay (Roche Molecular Systems, Inc.), is a powerful and versatile PCR-based detection system for nucleic acid targets. For a detailed description of the TaqMan assay, reagents and conditions for use therein, see, e.g., Holland et al., Proc. Natl. Acad. Sci., U.S.A. (1991) 88:7276-7280; U.S. Pat. Nos. 5,538,848, 5,723,591, and 5,876,930, all incorporated herein by reference in their entireties. Hence, primers and probes derived from regions of a target nucleic acid as described herein can be used in TaqMan analyses to detect a level of target mRNA in a biological sample. Analysis is performed in conjunction with thermal cycling by monitoring the generation of fluorescence signals. (Taq-Man is a registered trademark of Roche Molecular Systems.)

The fluorogenic 5' nuclease assay is conveniently performed using, for example, AmpliTaq Gold® DNA polymerase, which has endogenous 5' nuclease activity, to digest an internal oligonucleotide probe labeled with both a fluorescent reporter dye and a quencher (see, Holland et al., Proc Nat Acad Sci USA (1991) 88:7276-7280; and Lee et al., Nucl. Acids Res. (1993) 21:3761-3766). Assay results are detected by measuring changes in fluorescence that occur during the amplification cycle as the fluorescent probe is digested, uncoupling the dye and quencher labels and causing an increase in the fluorescent signal that is proportional to the amplification of target nucleic acid. (AmpliTaq Gold is a registered trademark of Roche Molecular Systems.)

The amplification products can be detected in solution or using solid supports. In this method, the TaqMan probe is designed to hybridize to a target sequence within the desired PCR product. The 5' end of the TaqMan probe contains a fluorescent reporter dye. The 3' end of the probe is blocked to prevent probe extension and contains a dye that will quench the fluorescence of the 5' fluorophore. During subsequent amplification, the 5' fluorescent label is cleaved off if a polymerase with 5' exonuclease activity is present in the reaction. Excision of the 5' fluorophore results in an increase in fluorescence that can be detected.

The first step for gene expression analysis is the isolation of mRNA from a target sample. The starting material is typically total RNA isolated from human tumors or tumor cell lines, and corresponding normal tissues or cell lines, respectively. Thus RNA can be isolated from a variety of primary tumors, including breast, lung, colon, prostate, brain, liver, kidney, pancreas, spleen, thymus, testis, ovary, uterus, head and neck, etc., tumor, or tumor cell lines, with pooled DNA from healthy donors. If the source of mRNA is a primary tumor, mRNA can be extracted, for example, from frozen or archived paraffin-embedded and fixed (e.g., formalin-fixed) tissue samples.

General methods for mRNA extraction are well known in the art and are disclosed in standard textbooks of molecular biology, including Ausubel et al., *Current Protocols of Molecular Biology* (Wiley and Sons, 1997). Methods for RNA extraction from paraffin embedded tissues are disclosed, for example, M. Cronin, Am J. Pathol 164(1):35-42 (2004), the contents of which are incorporated herein. In particular, RNA isolation can be performed using kits and reagents from commercial manufacturers according to the manufacturer's instructions. For example, total RNA from cells in culture can be isolated using RNeasy® mini-columns (Qiagen GmbH Corp.). Other commercially available RNA isolation kits include MasterPure™ Complete DNA and RNA Purification Kit (EPICENTRE® Biotechnologies, Madison, Wis.), mirVana (Applied Biosystems, Inc.), and Paraffin Block RNA Isolation Kit (Ambion, Inc.). Total RNA from tissue samples can be isolated using RNA STAT-60™ (IsoTex Diagnostics, Inc., Friendswood Tex.). RNA prepared from tumor can be isolated, for example, by cesium chloride density gradient centrifugation. (RNeasy is a registered trademark of Qiagen GmbH Corp.; MasterPure is a trademark of EPICENTRE Biotechnologies; RNA STAT-60 is a trademark of Tel-Test Inc.)

As RNA cannot serve as a template for PCR, the first step in gene expression profiling by RT-PCR is the reverse transcription of the RNA template into cDNA, followed by its exponential amplification in a PCR reaction. The two most commonly used reverse transcriptase enzymes are avilo myeloblastosis virus reverse transcriptase (AMV-RT) and Moloney murine leukemia virus reverse transcriptase (MMLV-RT). The reverse transcription step is typically primed using specific primers, random hexamers, or oligo-dT primers, depending on the circumstances and the goal of expression profiling. For example, extracted RNA can be reverse-transcribed using a GeneAmp® RNA PCR kit (Applied Biosystems Inc., Foster City, Calif.) according to the manufacturer's instructions. The derived cDNA can then be used as a template in a subsequent PCR reaction. (GeneAmp is a registered trademark of Applied Biosystems Inc.)

Although the PCR step can use a variety of thermostable DNA-dependent DNA polymerases, it typically employs the Taq DNA polymerase, which has a 5'-3' nuclease activity but lacks a 3'-5' proofreading endonuclease activity. Thus, TaqMan PCR typically utilizes the 5'-nuclease activity of Taq or Tth polymerase to hydrolyze a hybridization probe bound to its target amplicon, but any enzyme with equivalent 5' nuclease activity can be used. Two oligonucleotide primers are used to generate an amplicon. A third oligonucleotide, or probe, is designed to detect nucleotide sequence located between the two PCR primers. The probe is non-extendible by Taq DNA polymerase enzyme, and is labeled with a reporter fluorescent dye and a quencher fluorescent dye. Any laser-induced emission from the reporter dye is quenched by the quenching dye when the two dyes are located close together as they are on the probe. During the amplification reaction, the Taq DNA polymerase enzyme cleaves the probe in a template-dependent manner. The resultant probe fragments disassociate in solution, and signal from the released reporter dye is free from the quenching effect of the second fluorophore. One molecule of reporter dye is liberated for each new molecule synthesized, and detection of the unquenched reporter dye provides the basis for quantitative interpretation of the data. (TaqMan is a registered mark of Applied Biosystems.)

TaqMan RT-PCR can be performed using commercially available equipment, such as, for example, the ABI PRISM 7700® Sequence Detection System (Applied Biosystems, Foster City, Calif., USA), or the Lightcycler® (Roche Molecular Biochemicals, Mannheim, Germany). In a preferred embodiment, the 5' nuclease procedure is run on a real-time quantitative PCR device such as the ABI PRISM 7900™ Sequence Detection System™. The system consists of a thermocycler, laser, charge-coupled device (CCD), camera and computer. The system amplifies samples in a 96-well format on a thermocycler. During amplification, laser-induced fluorescent signal is collected in real-time through fiber optics cables for all 96 wells, and detected at the CCD. The system includes software for running the instrument and for analyzing the data. (PRISM 7700 is a registered trademark of Applied Biosystems; Lightcycler is a registered trademark of Roche Diagnostics GmbH LLC.)

5'-Nuclease assay data are initially expressed as $C_t$, or the threshold cycle. As discussed above, fluorescence values are recorded during every cycle and represent the amount of product amplified to that point in the amplification reaction. The point when the fluorescent signal is first recorded as statistically significant is the threshold cycle (Ct).

To minimize the effect of sample-to-sample variation, quantitative RT-PCR is usually performed using an internal standard, or one or more reference genes. The ideal internal standard is expressed at a constant level among different tissues, and is unaffected by the experimental treatment. RNAs that can be used to normalize patterns of gene expression include, e.g., mRNAs for the reference genes glyceraldehyde-3-phosphate-dehydrogenase (GAPDH) and β-actin.

A more recent variation of the RT-PCR technique is the real time quantitative PCR, which measures PCR product accumulation through a dual-labeled fluorogenic probe (i.e., TaqMan® probe). Real time PCR is compatible both with quantitative competitive PCR, where internal competitor for each target sequence is used for normalization, and with quantitative comparative PCR using a normalization gene contained within the sample, or a reference gene for RT-PCR. For further details see, e.g., Held et al., Genome Research 6:986-994 (1996).

Factors considered in PCR primer design include primer length, melting temperature (Tm), and G/C content, specificity, complementary primer sequences, and 3'-end sequence. In general, optimal PCR primers are generally 17-30 bases in length, and contain about 20-80%, such as, for example, about 50-60% G+C bases. Tm's between 50 and 80° C., e.g., about 50 to 70° C. can be used.

For further guidelines for PCR primer and probe design see, e.g., Dieffenbach, C. W. et al., "General Concepts for PCR Primer Design" in: PCR Primer, A Laboratory Manual, Cold Spring Harbor Laboratory Press, New York, 1995, pp. 133-155; Innis and Gelfand, "Optimization of PCRs" in: *PCR Protocols, A Guide to Methods and Applications*, CRC Press, London, 1994, pp. 5-11; and Plasterer, T. N. PrimerSelect: Primer and probe design. *Methods Mol. Biol.* 70:520-527 (1997), the entire disclosures of which are hereby expressly incorporated by reference.

Other suitable methods for assaying a level of a nucleic acid gene product include, e.g., microarrays; serial analysis of gene expression (SAGE); MassARRAY® analysis; digital gene expression (DGE) (J. Marioni, Genome Research 18(9):1509-1517 (2008), gene expression by massively parallel signature sequencing (see, e.g., Ding and Cantor, Proc. Nat'l Acad Sci 100:3059-3064 (2003); differential display (Liang and Pardee, Science 257:967-971 (1992)); amplified fragment length polymorphism (iAFLP) (Kawamoto et al., Genome Res. 12:1305-1312 (1999)); BeadArray™ technology (Illumina, San Diego, Calif.; Oliphant et al., Discovery of Markers for Disease (Supplement to Biotechniques), June 2002; Ferguson et al., Analytical Chemistry 72:5618 (2000)); BeadsArray for Detection of Gene Expression (BADGE), using the commercially available Luminex100 LabMAP system and multiple color-coded microspheres (Luminex Corp., Austin, Tex.) in a rapid assay for gene expression (Yang et al., Genome Res. 11:1888-1898 (2001)); and high coverage expression profiling (HiCEP) analysis (Fukumura et al., Nucl. Acids. Res. 31(16) e94 (2003)).

Introns

Assays to measure the amount of an RNA gene expression product can be targeted to intron sequences or exon sequences of the primary transcript. The amount of a spliced intron that is measured in human tissue samples is generally indicative of the amount of a corresponding exon (i.e. an exon from the same gene) present in the samples. Polynucleotides that consist of or are complementary to intron sequences can be used, e.g., in hybridization methods or amplification methods to assay the expression level of response indicator genes.

Measuring Levels of a Polypeptide Gene Product

Methods of measuring a level of a polypeptide gene product are known in the art and include antibody-based methods such as enzyme-linked immunoabsorbent assay (ELISA), radioimmunoassay (RIA), protein blot analysis, immunohistochemical analysis and the like. The measure of a polypeptide gene product may also be measured in vivo in the subject using an antibody that specifically binds a target polypeptide, coupled to a paramagnetic label or other label used for in vivo imaging, and visualizing the distribution of the labeled antibody within the subject using an appropriate in vivo imaging method, such as magnetic resonance imaging. Such methods also include proteomics methods such as mass spectrometric methods, which are known in the art.

Methods of Isolating RNA from Body Fluids

Methods of isolating RNA for expression analysis from blood, plasma and serum (See for example, Tsui N B et al. (2002) 48, 1647-53 and references cited therein) and from urine (See for example, Boom R et al. (1990) J Clin Microbiol. 28, 495-503 and reference cited therein) have been described.

Methods of Isolating RNA from Paraffin-Embedded Tissue

The steps of a representative protocol for profiling gene expression using fixed, paraffin-embedded tissues as the RNA source, including mRNA isolation, purification primer extension and amplification are provided in various published journal articles. (See, e.g., T. E. Godfrey et al., J. Molec. Diagnostics 2: 84-91 (2000); K. Specht et al., Am. J. Pathol. 158: 419-29 (2001), M. Cronin, et al., Am J Pathol 164:35-42 (2004)).

Manual and Computer-Assisted Methods and Products

The methods and systems described herein can be implemented in numerous ways. In one embodiment of particular interest, the methods involve use of a communications infrastructure, for example the Internet. Several embodiments are discussed below. It is also to be understood that the present disclosure may be implemented in various forms of hardware, software, firmware, processors, or a combination thereof. The methods and systems described herein can be implemented as a combination of hardware and software. The software can be implemented as an application program tangibly embodied on a program storage device, or different portions of the software implemented in the user's computing environment (e.g., as an applet) and on the reviewer's computing environment, where the reviewer may be located at a remote site associated (e.g., at a service provider's facility).

For example, during or after data input by the user, portions of the data processing can be performed in the user-side computing environment. For example, the user-side computing environment can be programmed to provide for defined test codes to denote a likelihood "risk score," where the score is transmitted as processed or partially processed responses to the reviewer's computing environment in the form of test code for subsequent execution of one or more algorithms to provide a results and/or generate a report in the reviewer's computing environment. The risk score can be a numerical score (representative of a numerical value) or a non-numerical score representative of a numerical value or range of numerical values (e.g., low, intermediate, or high).

The application program for executing the algorithms described herein may be uploaded to, and executed by, a machine comprising any suitable architecture. In general, the machine involves a computer platform having hardware such as one or more central processing units (CPU), a random access memory (RAM), and input/output (I/O) interface(s). The computer platform also includes an operating system and microinstruction code. The various processes and functions described herein may either be part of the microinstruction code or part of the application program (or a combination thereof) that is executed via the operating system. In addition, various other peripheral devices may be connected to the computer platform such as an additional data storage device and a printing device.

As a computer system, the system generally includes a processor unit. The processor unit operates to receive information, which can include test data (e.g., level of a risk gene, level of a reference gene product(s); normalized level of a gene; and may also include other data such as patient data. This information received can be stored at least temporarily in a database, and data analyzed to generate a report as described above.

Part or all of the input and output data can also be sent electronically; certain output data (e.g., reports) can be sent electronically or telephonically (e.g., by facsimile, e.g., using devices such as fax back). Exemplary output receiving devices can include a display element, a printer, a facsimile device and the like. Electronic forms of transmission and/or display can include email, interactive television, and the like. In an embodiment of particular interest, all or a portion of the input data and/or all or a portion of the output data (e.g., usually at least the final report) are maintained on a web server for access, preferably confidential access, with typical browsers. The data may be accessed or sent to health professionals as desired. The input and output data, including all or a portion of the final report, can be used to populate a patient's medical record which may exist in a confidential database at the healthcare facility.

A system for use in the methods described herein generally includes at least one computer processor (e.g., where the method is carried out in its entirety at a single site) or at least two networked computer processors (e.g., where data is to be input by a user (also referred to herein as a "client") and transmitted to a remote site to a second computer processor for analysis, where the first and second computer processors are connected by a network, e.g., via an intranet or internet). The system can also include a user component(s) for input; and a reviewer component(s) for review of data, generated reports, and manual intervention. Additional components of the system can include a server component(s); and a database(s) for storing data (e.g., as in a database of report elements, e.g., interpretive report elements, or a relational database (RDB) which can include data input by the user and data output. The computer processors can be processors that are typically found in personal desktop computers (e.g., IBM, Dell, Macintosh), portable computers, mainframes, minicomputers, or other computing devices.

The networked client/server architecture can be selected as desired, and can be, for example, a classic two or three tier client server model. A relational database management system (RDMS), either as part of an application server component or as a separate component (RDB machine) provides the interface to the database.

In one example, the architecture is provided as a database-centric client/server architecture, in which the client application generally requests services from the application server which makes requests to the database (or the database server) to populate the report with the various report elements as required, particularly the interpretive report elements, especially the interpretation text and alerts. The server(s) (e.g., either as part of the application server machine or a separate RDB/relational database machine) responds to the client's requests.

The input client components can be complete, stand-alone personal computers offering a full range of power and features to run applications. The client component usually operates under any desired operating system and includes a communication element (e.g., a modem or other hardware for connecting to a network), one or more input devices (e.g., a keyboard, mouse, keypad, or other device used to transfer information or commands), a storage element (e.g., a hard drive or other computer-readable, computer-writable storage medium), and a display element (e.g., a monitor, television, LCD, LED, or other display device that conveys information to the user). The user enters input commands into the computer processor through an input device. Generally, the user interface is a graphical user interface (GUI) written for web browser applications.

The server component(s) can be a personal computer, a minicomputer, or a mainframe and offers data management, information sharing between clients, network administration and security. The application and any databases used can be on the same or different servers.

Other computing arrangements for the client and server(s), including processing on a single machine such as a mainframe, a collection of machines, or other suitable configuration are contemplated. In general, the client and server machines work together to accomplish the processing of the present disclosure.

Where used, the database(s) is usually connected to the database server component and can be any device that will hold data. For example, the database can be a any magnetic or optical storing device for a computer (e.g., CDROM, internal hard drive, tape drive). The database can be located remote to the server component (with access via a network, modem, etc.) or locally to the server component.

Where used in the system and methods, the database can be a relational database that is organized and accessed according to relationships between data items. The relational database is generally composed of a plurality of tables (entities). The rows of a table represent records (collections of information about separate items) and the columns represent fields (particular attributes of a record). In its simplest conception, the relational database is a collection of data entries that "relate" to each other through at least one common field.

Additional workstations equipped with computers and printers may be used at point of service to enter data and, in some embodiments, generate appropriate reports, if desired. The computer(s) can have a shortcut (e.g., on the desktop) to launch the application to facilitate initiation of data entry, transmission, analysis, report receipt, etc. as desired.

Computer-Readable Storage Media

The present disclosure also contemplates a computer-readable storage medium (e.g. CD-ROM, memory key, flash memory card, diskette, etc.) having stored thereon a program which, when executed in a computing environment, provides for implementation of algorithms to carry out all or a portion of the results of a response likelihood assessment as described herein. Where the computer-readable medium contains a complete program for carrying out the methods described herein, the program includes program instructions for collecting, analyzing and generating output, and generally includes computer readable code devices for interacting with a user as described herein, processing that data in conjunction with analytical information, and generating unique printed or electronic media for that user.

Where the storage medium provides a program that provides for implementation of a portion of the methods described herein (e.g., the user-side aspect of the methods (e.g., data input, report receipt capabilities, etc.)), the program provides for transmission of data input by the user (e.g., via the internet, via an intranet, etc.) to a computing environment at a remote site. Processing or completion of processing of the data is carried out at the remote site to generate a report. After review of the report, and completion of any needed manual intervention, to provide a complete report, the complete report is then transmitted back to the user as an electronic document or printed document (e.g., fax or mailed paper report). The storage medium containing a program according to the present disclosure can be packaged with instructions (e.g., for program installation, use, etc.) recorded on a suitable substrate or a web address where such instructions may be obtained. The computer-readable storage medium can also be provided in combination with one or more reagents for carrying out response likelihood assessment (e.g., primers, probes, arrays, or other such kit components).

Methods of Data Analysis

Reference Normalization

In order to minimize expression measurement variations due to non-biological variations in samples, e.g., the amount and quality of expression product to be measured, raw expression level data measured for a gene product (e.g., cycle threshold ($C_t$) measurements obtained by qRT-PCR) may be normalized relative to the mean expression level data obtained for one or more reference genes. In one approach to normalization, a small number of genes are used as reference genes; the genes chosen for reference genes typically show a minimal amount of variation in expression from sample to sample and the expression level of other genes is compared to the relatively stable expression of the reference genes. In the global normalization approach, the expression level of each gene in a sample is compared to an average expression level in the sample of all genes in order to compare the expression of a particular gene to the total amount of material.

Unprocessed data from qRT-PCR is expressed as cycle threshold ($C_t$), the number of amplification cycles required for the detectable signal to exceed a defined threshold. High $C_t$ is indicative of low expression since more cycles are required to detect the amplification product. Normalization may be carried out such that a one-unit increase in normalized expression level of a gene product generally reflects a 2-fold increase in quantity of expression product present in the sample. For further information on normalization techniques applicable to qRT-PCR data from tumor tissue, see, e.g., Silva S et al. (2006) *BMC Cancer* 6, 200; de Kok J et al. (2005) Laboratory Investigation 85, 154-159. Gene expression may then be standardized by dividing the normalized gene expression by the standard deviation of expression across all patients for that particular gene. By standardizing normalized gene expression the hazard ratios across genes are comparable and reflect the relative risk for each standard deviation of gene expression.

Statistical Analysis

One skilled in the art will recognize that variety of statistical methods are available that are suitable for comparing the expression level of a gene (or other variable) in two groups and determining the statistical significance of expression level differences that are found. (See e.g., H. Motulsky, *Intuitive Biostatistics*(Oxford University Press, 1995); D. Freedman, *Statistics* (W.W. Norton & Co, 4$^{th}$ Ed., 2007). For example, a Cox proportional hazards regression model may be fit to a particular clinical time-to-event endpoint (e.g., RFI, OS). One assumption of the Cox proportional hazards regression model is the proportional hazards assumption, i.e. the assumption that model effects multiply the underlying hazard. Assessments of model adequacy may be performed including, but not limited to, examination of the cumulative sum of martingale residuals. One skilled in the art would recognize that there are numerous statistical methods that may be used (e.g., Royston and Parmer (2002), smoothing spline, etc.) to fit a flexible parametric model using the hazard scale and the Weibull distribution with natural spline smoothing of the log cumulative hazards function, with effects allowed to be time-dependent. (See, P. Royston, M. Parmer, *Statistics in Medicine* 21(15:2175-2197 (2002).) The relationship between recurrence risk and (1) recurrence risk groups; and (2) clinical/pathologic covariates (e.g., tumor stage, tumor grade, presence of necrosis, lymphatic or vascular invasion, etc.) may also be tested for significance. Additional examples of models include logistic or ordinal logistic regression models in which the association between gene expression and dichotomous (for logistic) or ordinal (for ordinal logistic) clinical endpoints (i.e. stage, necrosis, grade) may be evaluated. (See e.g., D. Hosmer and S. Lemeshow, *Applied Logistic Regression* (John Wiley and Sons, 1989).

In an exemplary embodiment, results were adjusted for multiple hypothesis tests, and allowed for a 10% false discovery rate (FDR), using Storey's procedure, and using TDRAS with separate classes (M. Crager, Gene identification using true discovery rate degree of association sets and estimates corrected for regression to the mean, *Statistics in Medicine* (published online December 2009). In another embodiment, genes with significant association with RFI were identified through cross-validation techniques in which forward stepwise Cox PH regression was employed using a subset of factors identified through Principal Component Analysis (PCA).

Methods for calculating correlation coefficients, particularly the Pearson product-moment correlation coefficient are known in the art. (See e.g., J. Rodgers and W. Nicewander, The American Statistician, 42, 59-66 (1988); H. Motulsky, H., Intuitive Biostatistics (Oxford University Press, 1995). To perform particular biological processes, genes often work together in a concerted way, i.e. they are co-expressed. Co-expressed gene groups identified for a disease process like cancer can serve as biomarkers for disease progression and response to treatment. Such co-expressed genes can be assayed in lieu of, or in addition to, assaying of the prognostic and/or predictive gene with which they are co-expressed.

One skilled in the art will recognize that many co-expression analysis methods now known or later developed will fall within the scope and spirit of the present invention. These methods may incorporate, for example, correlation coefficients, co-expression network analysis, clique analysis, etc., and may be based on expression data from RT-PCR, microarrays, sequencing, and other similar technologies. For example, gene expression clusters can be identified using pair-wise analysis of correlation based on Pearson or Spearman correlation coefficients. (See, e.g., Pearson K. and Lee A., Biometrika 2, 357 (1902); C. Spearman, Amer. J. Psychol 15:72-101 (1904); J. Myers, A. Well, *Research Design and Statistical Analysis*, p. 508 (2nd Ed., 2003).) In general, a correlation coefficient of equal to or greater than 0.3 is considered to be statistically significant in a sample size of at least 20. (See, e.g., G. Norman, D. Streiner, *Biostatistics: The Bare Essentials,* 137-138 (3rd Ed. 2007).)

All aspects of the present disclosure may also be practiced such that a limited number of additional genes that are co-expressed with the disclosed genes, for example as evidenced by high Pearson correlation coefficients, are included in a prognostic or predictive test in addition to and/or in place of disclosed genes.

Having described the invention, the same will be more readily understood through reference to the following Examples, which are provided by way of illustration, and are not intended to limit the invention in any way. All citations throughout the disclosure are hereby expressly incorporated by reference.

Examples

Two studies were performed to demonstrate the feasibility of gene expression profiling from renal tumors obtained from renal cell carcinoma patients. (See Abstract by M. Zhou, et al., Optimized RNA extraction and RT-PCR assays provide successful molecular analysis on a wide variety of archival fixed tissues, AACR Annual Meeting (2007)).

Study Design

Renal tumor tissue was obtained from approximately 1200 patients from the Cleveland Clinic Foundation (CCF) database. This database consists of patients who were diagnosed with renal carcinoma, clear cell type, stage I, II and III between the years of 1985 and 2003, who had available paraffin-embedded tumor (PET) blocks and adequate clinical follow-up, and who were not treated with adjuvant/neo-adjuvant systemic therapy. Patients with inherited VHL disease or bilateral tumors were also excluded. Tumors were graded using (1) Fuhrman grading system as noted in the World Health Organization Classification of Tumours: Pathology and Genetics: Tumours of the Urinary System and Male Genital Organs; and (2) the modified Fuhrman grading system (Table 1). In general, if no nodal involvement is expected or observed for patients, inspection of nodal involvement is not conducted and Nx is noted. In this study, Nx was treated as N0 for purposes of stage classification. The expression of 732 genes was quantitatively assessed for each patient tissue sample.

TABLE 1

Fuhrman Grading Systems

| Fuhrman Grade (Modified) | Fuhrman Grade (WHO) |
|---|---|
| 1 Nuclei small as lymphocyte with condensed chromatin | Small, round, uniform nuclei (~10 um); nucleoli absent or inconspicuous (at 400x) |

TABLE 1-continued

Fuhrman Grading Systems

| Fuhrman Grade (Modified) | Fuhrman Grade (WHO) |
|---|---|
| 2 Nuclei both small as lymphocytes with condensed chromatin and other nuclei demonstrating enlarged, open chromatin | Larger nuclei (~15 um) with irregular outline; small nucleoli present (at 400x) |
| 3 All nuclei enlarged with open chromatin | Larger nuclei (approaching 20 um) with more irregular outline; prominent nucleoli present (at 100x) |
| 4 Large bizarre nuclei | Grade 3 features with pleomorphic or multilobed nuclei, with or without spindle cells |

Inclusion Criteria (1) Patients who underwent nephrectomy at CCF and who have a minimum of 6 months clinical follow-up or have recurrent RCC, documented in the clinical chart, database or registry.

(2) Diagnosed with RCC, clear cell type, stage I, II, or III.

(3) Renal blocks fixed in Formalin, Hollandes fluid or Zenkers fixative.

Exclusion Criteria (1) No tumor block available from initial diagnosis in the Cleveland Clinic archive.

(2) No tumor or very little tumor (<5% of invasive cancer cell area) in block as assessed by examination of the Hollandes and/or hematoxylin and eosin stained (H&E) slide.

(3) High cycle threshold ($C_t$) values of reference genes. All samples regardless of their RNA amount will be tested by RT-qPCR, but only plates where the average Ct of reference genes is less than 35 will be analyzed.

(4) Patients with inherited VHL disease and/or bilateral tumors (5) Patients who received neo-adjuvant or adjuvant systemic therapy Concordance for Clinical and Pathologic Factors Two separate pathology laboratories conducted analyses of several clinical and pathologic factors using the same standardized measures. The level of concordance, by covariate, is provided in Table 2, below. For purposes of the statistical analysis, the determination of only one of the central laboratories was used.

TABLE 2

Concordance between two central laboratories for clinical/pathologic covariates

| Covariate | Method of analysis | Concordance |
|---|---|---|
| Presence of necrosis | Microscopic technique per Leibovich BC et al. (2003) Cancer 97(3), 1663-1671. | 47% |
| Tumor grade | Fuhrman | 65% |

Expression Profile Gene Panel

The RNA from paraffin embedded tissue (PET) samples obtained from 942 patients who met all inclusion/exclusion criteria was extracted using protocols optimized for fixed renal tissue and perform molecular assays of quantitative gene expression using TaqMan® RT-PCR. RT-PCR was performed with RNA input at 1.0 ng per 5 μL-reaction volume using two 384 well plates.

RT-PCR analysis of PET samples was conducted using 732 genes. These genes were evaluated for association with the primary and secondary endpoints, recurrence-free interval (RFI), disease-free survival (DFS) and overall survival (OS).

All primary and secondary analyses were conducted on reference normalized gene expression levels using the mean of the reference genes for normalization. Three normalization schemes were tested using AAMP, ARF1, ATP5E, EEF1A1, GPX1, RPS23, SDHA, UBB, and RPLP1. Some or all of the other genes in the test panel were used in analyses of alternative normalization schemes.

Of the 732 genes, 647 were deemed evaluable for further consideration. The outcome analyses of the 647 evaluable genes were adjusted for multiple hypothesis tests, by allowing for a 10% false discovery rate (FDR), using Storey's procedure, and using True Discovery Rate Degree of Association Sets (TDRDAS) with separate classes (M. Crager, Gene identification using true discovery rate degree of association sets and estimates corrected for regression to the mean, *Statistics in Medicine* 29:33-45 (2009)). Unadjusted for baseline covariates and without controlling the FDR, a subset of 448 (69%) of genes were identified as significantly associated with RFI ($p \leq 0.05$). Additional analysis was conducted using a supervised principal component analysis (PCA) on a subset of 188 genes that have maximum lower bound (MLB) >1.2 using TDRDAS analysis, controlling the FDR but not taking into account the separate classes. The top 10 factors were modified by keeping the genes with high factor loadings (loading/max loading >0.7) were kept. The modified top 10 factors were put into a 5-fold cross validation to assess performance of the gene groups and identify factors that were appearing most frequently.

Genes that had a significant association ($p \leq 0.05$) with risk of recurrence are listed in Tables 3a and 3b, wherein genes that are positively associated with a good prognosis (i.e., increased expression indicates a lower risk of recurrence) are listed in Table 3a. Genes that are negatively associated with a good prognosis (i.e., increased expression indicates a higher risk of recurrence) are listed in Table 3b. Genes that were associated, positively or negatively, with a good prognosis but not associated with clinical/pathologic covariates are BBC3, CCR7, CCR4, and VCAN. In addition, genes associated positively with a good prognosis after adjusting for clinical and pathological covariates (stage, tumor grade, tumor size, nodal status, and presence of necrosis) are listed in Table 8a. Genes associated negatively with a good prognosis after adjusting for clinical/pathologic covariates are listed in Table 8b. Of those genes listed in Tables 8a and 8b, 16 genes with significant association, positively or negatively, with a good prognosis after adjusting for clinical and pathologic covariates and controlling the false discovery rate at 10% are listed in Table 9.

Figure 1B:
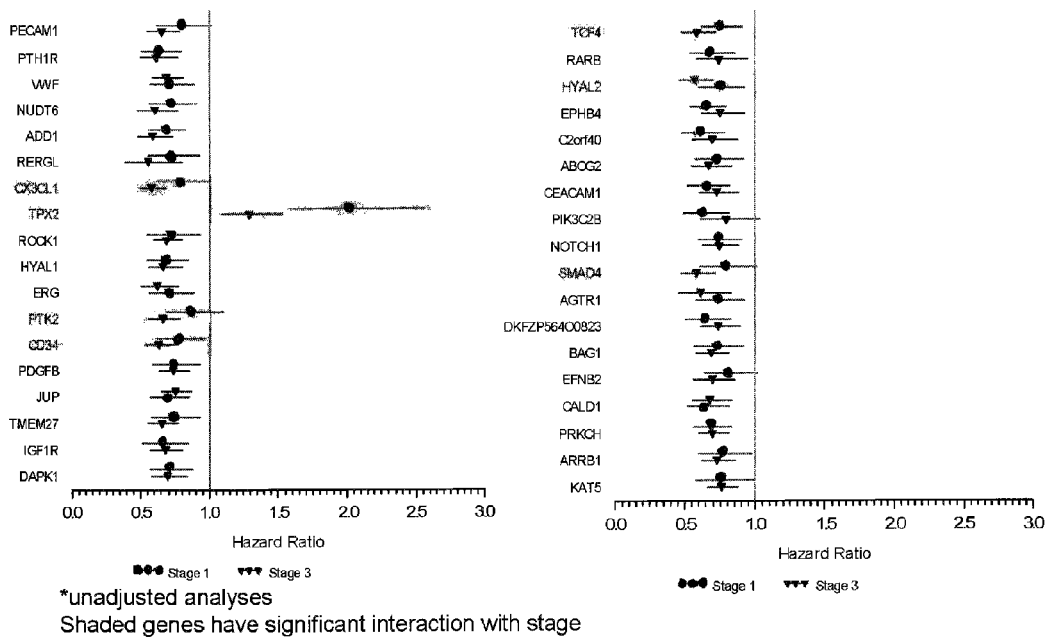
Figure 1C:
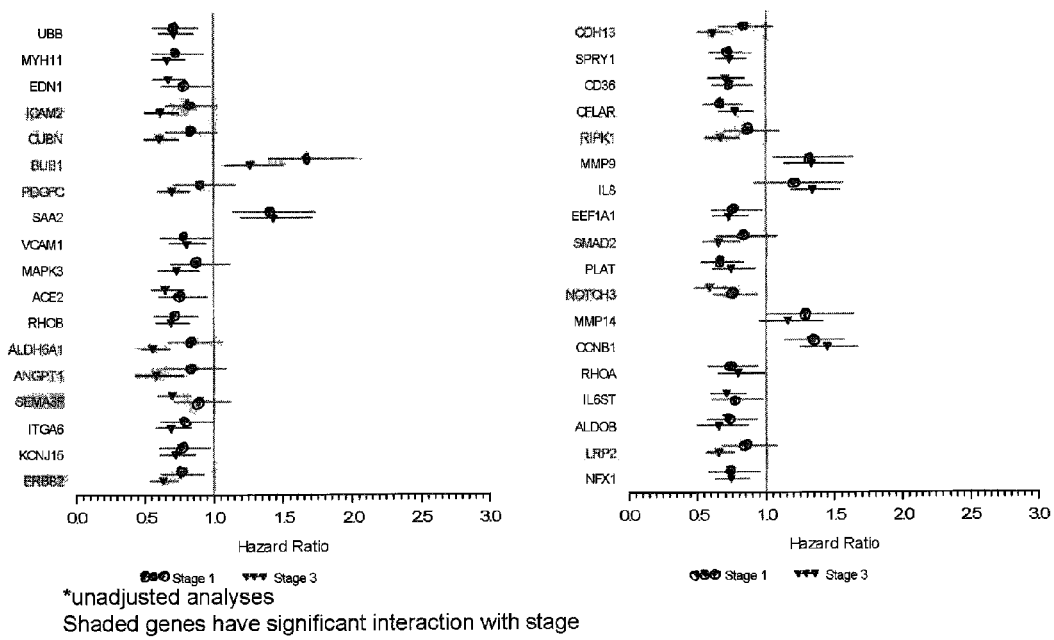
Figure 2:
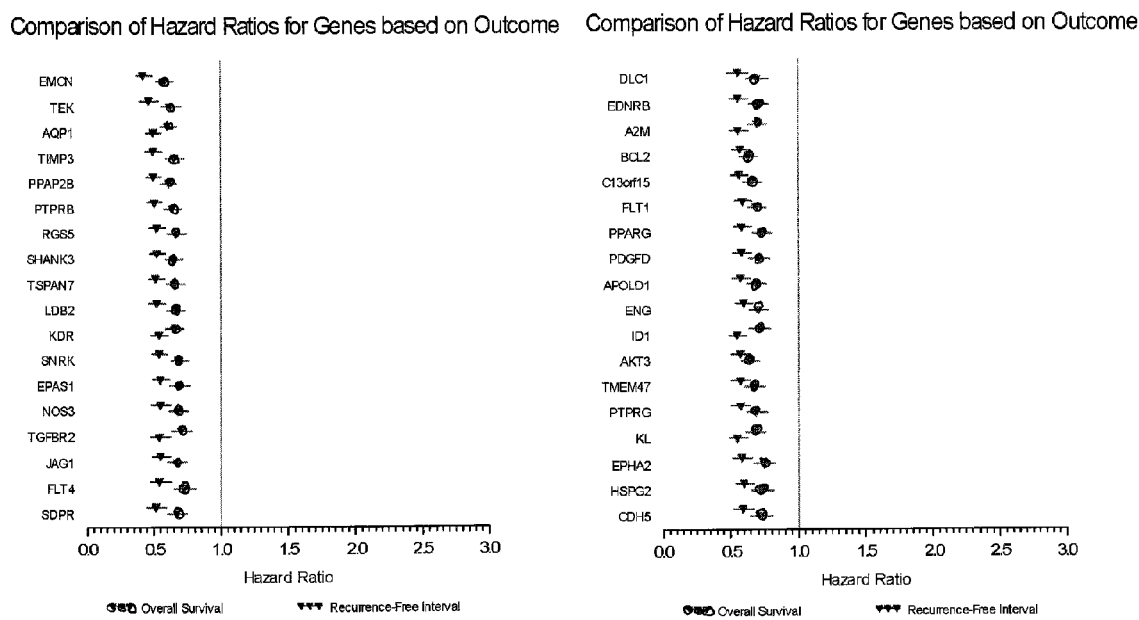
FIG. 2: Consistent results across endpoints (OS and RFI) for exemplary genes

For the majority of these genes significantly associated with RFI ($p \leq 0.05$) (82%), increased expression is associated with a good prognosis. Most of the genes significantly associated with RFI showed consistency between (1) between stages (I-III); (2) primary and secondary endpoints (RFI and OS). See, e.g., FIGS. 1 and 2, respectively.

From this analysis, certain gene subsets emerged as significantly associated with recurrence and overall survival. For example, increased expression of angiogenesis genes (e.g., EMCN, PPAP2B, NOS3, NUDT6, PTPRB, SNRK, APOLD1, PRKCH, and CEACAM1), cell adhesion/extracellular matrix genes (e.g., ITGB5, ITGB1, A2M, TIMP3), immune response genes (e.g., CCL5, CCXL9, CCR7, IL8, IL6, and CX3CL1), cell cycle (e.g., BUB1, TPX2), apoptosis (e.g., CASP10), and transport genes (AQP1) were strongly associated, positively or negatively, with RFI.

Also, certain genes that are associated with pathway targets for renal cancer drugs (sunitinib, sorafenib, temsirolimus, bevacizumab, everolimus, pazopanib) were identified as having a significant association with outcome, including: KIT, PDGFA, PDGFB, PDGFC, PDGFD, PDGFRb, KRAS, RAF1, MTOR, HIF1AN, VEGFA, VEGFB, and FLT4.

Figure 3:
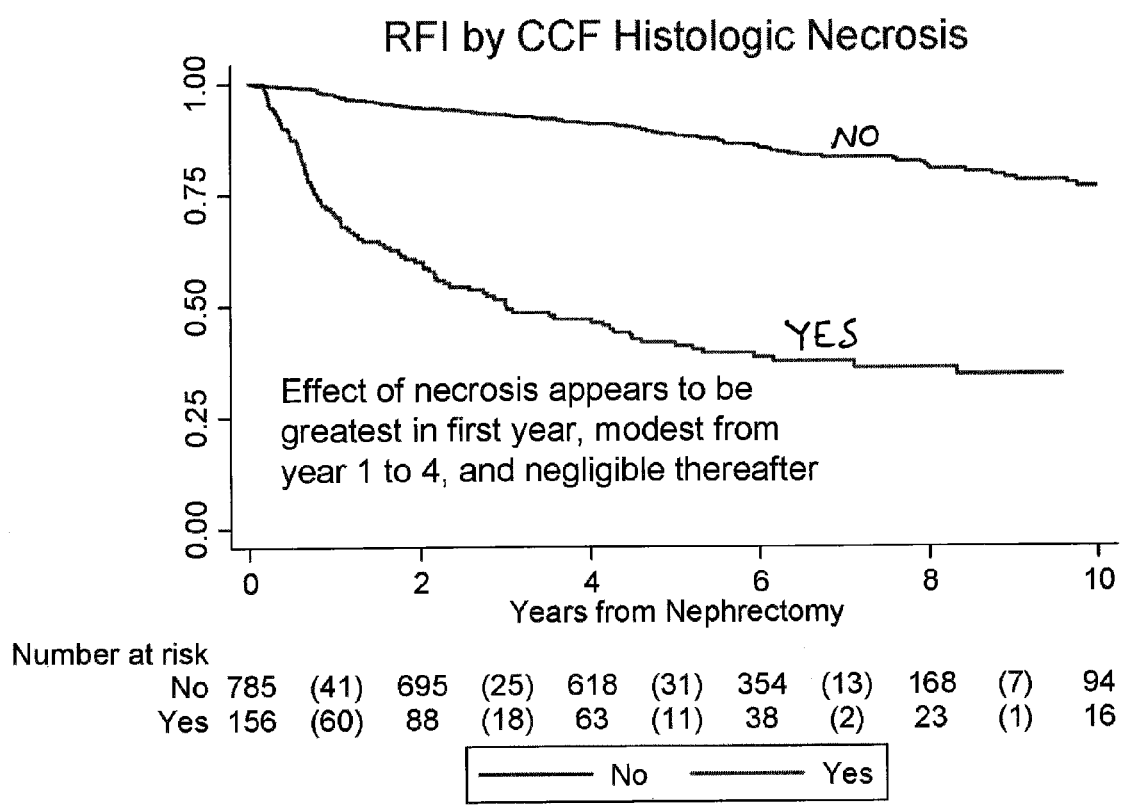
FIG. 3: Kaplan-Meier curve: Recurrence Free Internal (RFI) by Cleveland Clinic Foundation (CCF) histologic necrosis

It was determined that the presence of necrosis in these tumors was associated with a higher risk of recurrence, at least in the first 4 years after surgery. See FIG. 3. However, the prognostic effect of necrosis after year 4 was negligible.

It was also determined that expression of certain genes was correlated, positively or negatively, with pathologic and/or clinical factors ("proxy genes"). For example, increased expression of the proxy genes listed in Tables 4a-7b correlate, positively or negatively, with tumor stage, tumor grade, presence of necrosis, and nodal invasion, respectively. In Tables 4a-7b, gene expression was normalized and then standardized such that the odds ratio (OR) reflects a one standard deviation change in gene expression.

From these, key genes were identified as good proxies for baseline covariates (stage, grade, necrosis), including TSPAN7, TEK, LDB2, TIMP3, SHANK3, RGS5, KDR, SDPR, EPAS1, ID1, TGFBR2, FLT4, SDPR, ENDRB, JAG1, DLC1, and KL. Several of these genes are in the hypoxia-induced pathway: SHANK3, RGS5, EPAS1, KDR, JAG1, TGFBR2, FLT4, SDPR, DLC1, EDNRB.

Figure 4:
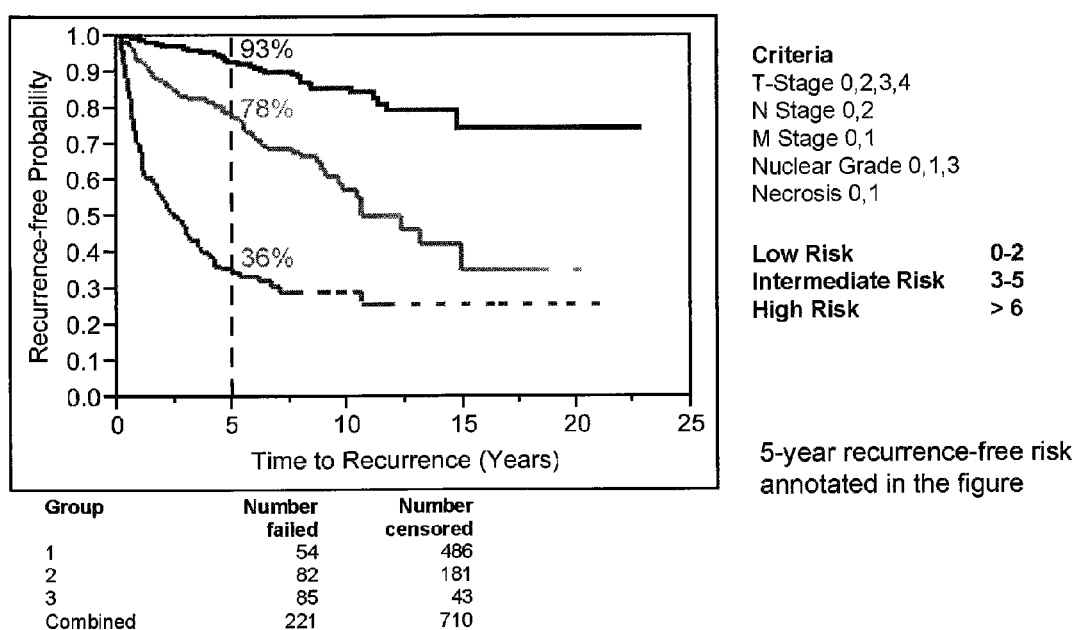
FIG. 4: Performance of Mayo prognostic tool applied to CCF data
Figure 5:
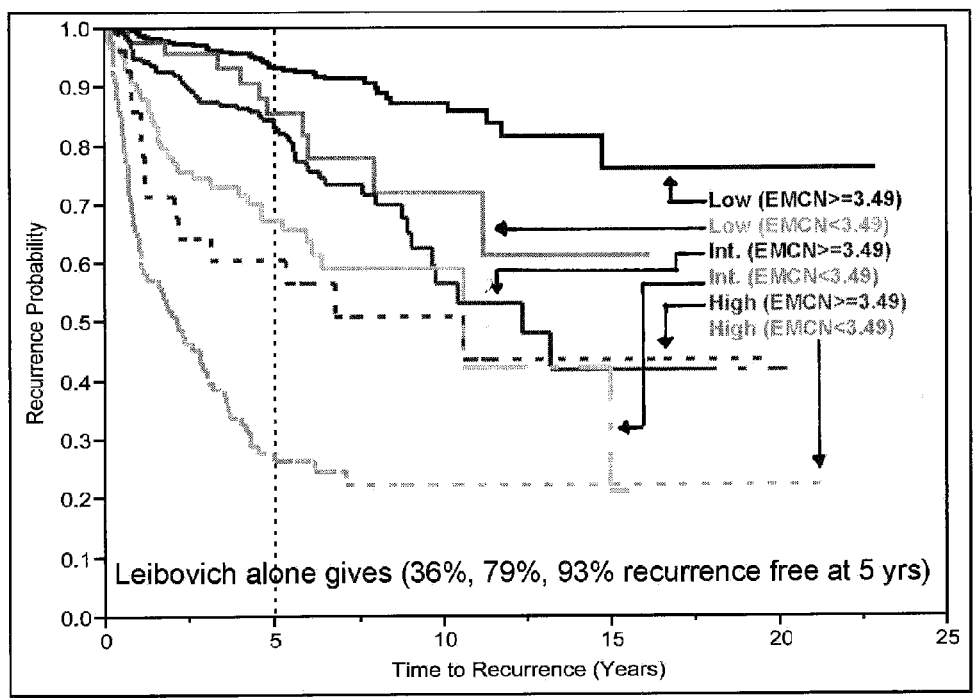
FIG. 5: Example of using one gene to improve estimate: EMCN in addition to Mayo Criteria
Figure 6:
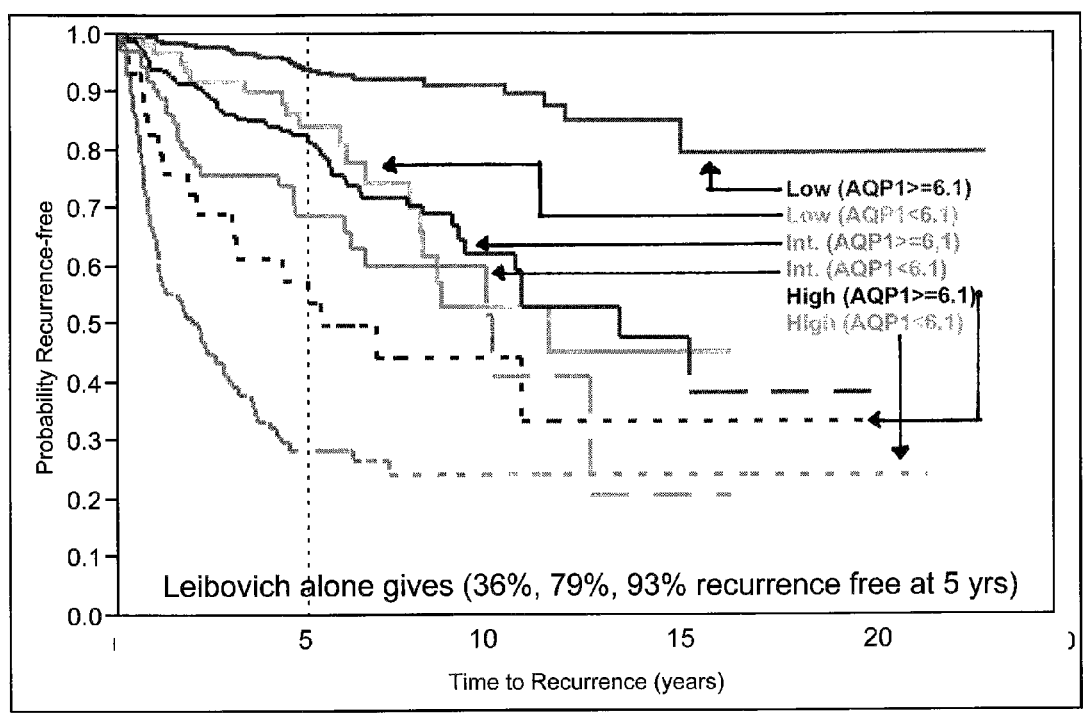
FIG. 6: Example of using one gene to improve estimate: AQP1 in addition to Mayo Criteria
Figure 7:
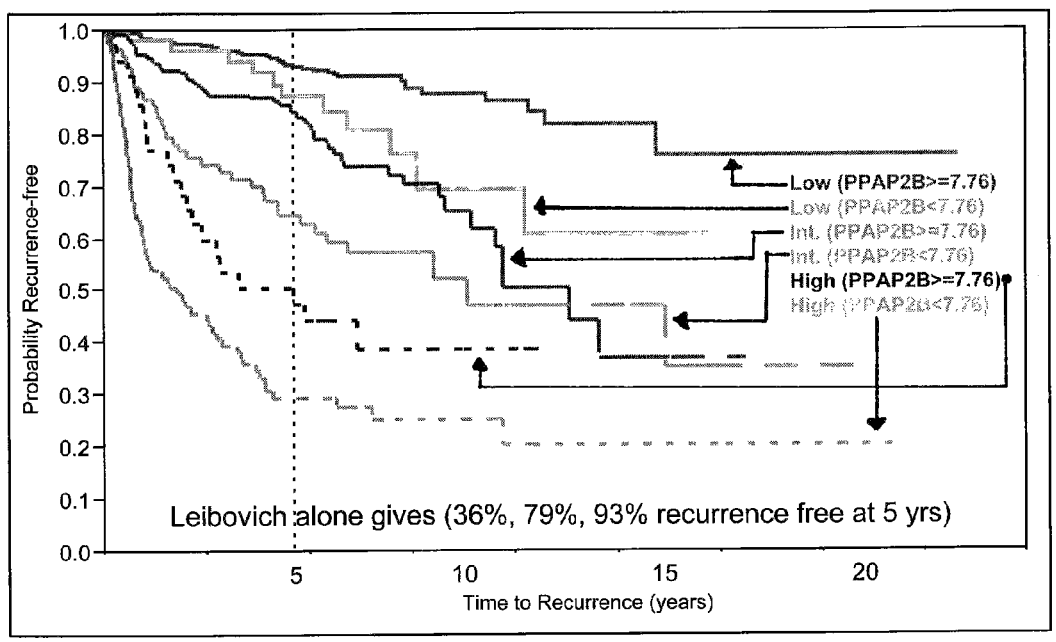
FIG. 7: Example of using one gene to improve estimate: PPAP2B in addition to Mayo Criteria

FIGS. 4-7 provide a comparison of patient stratification (Low, Intermediate, or High Risk) obtained by applying the Mayo prognostic tool (described in Leibovich et al. "prediction of progression after radical nephrectomy for patients with clear cell renal cell carcinoma" (2003) Cancer 97:1663-1671) CCF expression data. As shown in FIG. 4, the Mayo prognostic tool alone provides for stratification into three populations Low Risk (93% recurrence free at 5 years), Intermediate Risk (79% recurrence free at 5 years), and High Risk (36% recurrence free at 5 years). In contrast, use of expression data from even one gene (as exemplified by EMCN (FIG. 5.), AQP1 (FIG. 6), or PPAP2B (FIG. 7)) allowed for more detailed stratification of patients according to risk.

TABLE 3a

Genes for which increased expression is associated with lower risk of cancer recurrence (p-value ≤ .05)

| Gene | Official Symbol | Univariate Cox Analyses (No Covariate Adjustment) with RFI | |
|---|---|---|---|
| | | p-value for HR | HR |
| YB-1.2 | YBX1 | <0.0001 | 0.75 |
| XIAP.1 | XIAP | 0.0009 | 0.81 |
| WWOX.5 | WWOX | <0.0001 | 0.71 |
| VWF.1 | VWF | <0.0001 | 0.61 |
| VEGF.1 | VEGFA | <0.0001 | 0.75 |
| VCAM1.1 | VCAM1 | <0.0001 | 0.66 |
| USP34.1 | USP34 | 0.0003 | 0.79 |
| UMOD.1 | UMOD | <0.0001 | 0.68 |
| UGCG.1 | UGCG | <0.0001 | 0.71 |
| UBB.1 | UBB | <0.0001 | 0.62 |
| UBE1C.1 | UBA3 | 0.0003 | 0.79 |
| TS.1 | TYMS | 0.0056 | 0.83 |
| tusc4.2 | TUSC4 | <0.0001 | 0.76 |

TABLE 3a-continued

Genes for which increased expression is associated with lower risk of cancer recurrence (p-value ≤ .05)

| Gene | Official Symbol | Univariate Cox Analyses (No Covariate Adjustment) with RFI | |
|---|---|---|---|
| | | p-value for HR | HR |
| TSPAN7.2 | TSPAN7 | <0.0001 | 0.52 |
| TSC2.1 | TSC2 | 0.0043 | 0.82 |
| TSC1.1 | TSC1 | <0.0001 | 0.71 |
| P53.2 | TP53 | 0.0008 | 0.81 |
| TOP2B.2 | TOP2B | 0.0001 | 0.80 |
| TNFSF12.1 | TNFSF12 | <0.0001 | 0.68 |
| TRAIL.1 | TNFSF10 | 0.0065 | 0.83 |
| TNFRSF11B.1 | TNFRSF11B | 0.0002 | 0.78 |
| TNFRSF10D.1 | TNFRSF10D | <0.0001 | 0.76 |
| DR5.2 | TNFRSF10B | <0.0001 | 0.75 |
| TNFAIP6.1 | TNFAIP6 | 0.0005 | 0.79 |
| TMEM47.1 | TMEM47 | <0.0001 | 0.57 |
| TMEM27.1 | TMEM27 | <0.0001 | 0.58 |
| TLR3.1 | TLR3 | <0.0001 | 0.72 |
| TIMP3.3 | TIMP3 | <0.0001 | 0.50 |
| TIMP2.1 | TIMP2 | <0.0001 | 0.73 |
| THBS1.1 | THBS1 | 0.0002 | 0.79 |
| TGFBR2.3 | TGFBR2 | <0.0001 | 0.54 |
| TGFBR1.1 | TGFBR1 | <0.0001 | 0.71 |
| TGFB2.2 | TGFB2 | <0.0001 | 0.65 |
| TGFA.2 | TGFA | <0.0001 | 0.70 |
| TEK.1 | TEK | <0.0001 | 0.47 |
| TCF4.1 | TCF4 | <0.0001 | 0.62 |
| TAP1.1 | TAP1 | 0.0024 | 0.82 |
| TAGLN.1 | TAGLN | <0.0001 | 0.70 |
| TACSTD2.1 | TACSTD2 | <0.0001 | 0.72 |
| SUCLG1.1 | SUCLG1 | <0.0001 | 0.72 |
| STK11.1 | STK11 | <0.0001 | 0.76 |
| STAT5B.2 | STAT5B | <0.0001 | 0.71 |
| STAT5A.1 | STAT5A | <0.0001 | 0.72 |
| STAT3.1 | STAT3 | 0.0016 | 0.80 |
| SPRY1.1 | SPRY1 | <0.0001 | 0.68 |
| SPARCL1.1 | SPARCL1 | <0.0001 | 0.71 |
| SPARC.1 | SPARC | 0.0009 | 0.80 |
| SOD1.1 | SOD1 | 0.0114 | 0.84 |
| SNRK.1 | SNRK | <0.0001 | 0.54 |
| SNAI1.1 | SNAI1 | 0.0055 | 0.82 |
| MADH4.1 | SMAD4 | <0.0001 | 0.60 |
| MADH2.1 | SMAD2 | <0.0001 | 0.64 |
| SLC34A1.1 | SLC34A1 | 0.0004 | 0.76 |
| SLC22A6.1 | SLC22A6 | 0.0003 | 0.77 |
| SKIL.1 | SKIL | 0.0004 | 0.79 |
| SHANK3.1 | SHANK3 | <0.0001 | 0.53 |
| SGK.1 | SGK1 | <0.0001 | 0.67 |
| FRP1.3 | SFRP1 | 0.0355 | 0.86 |
| SEMA3F.3 | SEMA3F | <0.0001 | 0.67 |
| SELENBP1.1 | SELENBP1 | 0.0016 | 0.81 |
| SDPR.1 | SDPR | <0.0001 | 0.51 |
| SDHA.1 | SDHA | 0.0003 | 0.77 |
| SCNN1A.2 | SCNN1A | 0.0134 | 0.83 |
| SCN4B.1 | SCN4B | <0.0001 | 0.68 |
| KIAA1303 raptor.1 | RPTOR | <0.0001 | 0.77 |
| RPS6KB1.3 | RPS6KB1 | <0.0001 | 0.73 |
| RPS6KAI.1 | RPS6KA1 | 0.0291 | 0.86 |
| RPS23.1 | RPS23 | <0.0001 | 0.73 |
| ROCK2.1 | ROCK2 | <0.0001 | 0.66 |
| ROCK1.1 | ROCK1 | <0.0001 | 0.58 |
| RIPK1.1 | RIPK1 | <0.0001 | 0.64 |
| rhoC.1 | RHOC | 0.0213 | 0.86 |
| RhoB.1 | RHOB | <0.0001 | 0.63 |
| ARHA.1 | RHOA | <0.0001 | 0.64 |
| RGS5.1 | RGS5 | <0.0001 | 0.52 |
| FLJ22655.1 | RERGL | <0.0001 | 0.51 |
| NFKBp65.3 | RELA | 0.0027 | 0.82 |
| RB1.1 | RB1 | <0.0001 | 0.73 |
| RASSF1.1 | RASSF1 | 0.0040 | 0.83 |
| RARB.2 | RARB | <0.0001 | 0.57 |
| RALBP1.1 | RALBP1 | <0.0001 | 0.73 |
| RAF1.3 | RAF1 | 0.0008 | 0.81 |
| PTPRG.1 | PTPRG | <0.0001 | 0.57 |

TABLE 3a-continued

Genes for which increased expression is associated with lower risk of cancer recurrence (p-value ≤ .05)

Univariate Cox Analyses (No Covariate Adjustment) with RFI

| Gene | Official Symbol | p-value for HR | HR |
|---|---|---|---|
| PTPRB.1 | PTPRB | <0.0001 | 0.51 |
| PTN.1 | PTN | <0.0001 | 0.71 |
| PTK2.1 | PTK2 | <0.0001 | 0.61 |
| PTHR1.1 | PTH1R | <0.0001 | 0.55 |
| PTEN.2 | PTEN | <0.0001 | 0.74 |
| PSMB9.1 | PSMB9 | 0.0025 | 0.82 |
| PSMB8.1 | PSMB8 | 0.0239 | 0.85 |
| PRSS8.1 | PRSS8 | <0.0001 | 0.71 |
| PRPS2.1 | PRPS2 | 0.0156 | 0.85 |
| PRKCH.1 | PRKCH | <0.0001 | 0.63 |
| PPP2CA.1 | PPP2CA | <0.0001 | 0.77 |
| PPARG.3 | PPARG | <0.0001 | 0.59 |
| PPAP2B.1 | PPAP2B | <0.0001 | 0.50 |
| PLG.1 | PLG | <0.0001 | 0.70 |
| PLAT.1 | PLAT | <0.0001 | 0.64 |
| PLA2G4C.1 | PLA2G4C | <0.0001 | 0.67 |
| PIK3CA.1 | PIK3CA | <0.0001 | 0.75 |
| PI3K.2 | PIK3C2B | <0.0001 | 0.56 |
| PFKP.1 | PFKP | 0.0067 | 0.84 |
| CD31.3 | PECAM1 | <0.0001 | 0.60 |
| PDZK3.1 | PDZK3 | 0.0005 | 0.77 |
| PDZK1.1 | PDZK1 | <0.0001 | 0.69 |
| PDGFRb.3 | PDGFRB | <0.0001 | 0.74 |
| PDGFD.2 | PDGFD | <0.0001 | 0.58 |
| PDGFC.3 | PDGFC | <0.0001 | 0.66 |
| PDGFB.3 | PDGFB | <0.0001 | 0.63 |
| PDGFA.3 | PDGFA | <0.0001 | 0.75 |
| PCK1.1 | PCK1 | <0.0001 | 0.65 |
| PCCA.1 | PCCA | <0.0001 | 0.66 |
| PARD6A.1 | PARD6A | 0.0001 | 0.76 |
| Pak1.2 | PAK1 | 0.0011 | 0.81 |
| PAH.1 | PAH | 0.0296 | 0.86 |
| OGG1.1 | OGG1 | 0.0051 | 0.84 |
| BFGF.3 | NUDT6 | <0.0001 | 0.54 |
| NRG1.3 | NRG1 | 0.0049 | 0.81 |
| NPR1.1 | NPR1 | <0.0001 | 0.73 |
| NPM1.2 | NPM1 | <0.0001 | 0.73 |
| NOTCH3.1 | NOTCH3 | <0.0001 | 0.70 |
| NOTCH2.1 | NOTCH2 | 0.0040 | 0.84 |
| NOTCH1.1 | NOTCH1 | <0.0001 | 0.64 |
| NOS3.1 | NOS3 | <0.0001 | 0.55 |
| NOS2A.3 | NOS2 | <0.0001 | 0.66 |
| NOL3.1 | NOL3 | 0.0132 | 0.85 |
| NFX1.1 | NFX1 | <0.0001 | 0.67 |
| NFKBp50.3 | NFKB1 | 0.0001 | 0.77 |
| NFATC2.1 | NFATC2 | 0.0003 | 0.78 |
| NFAT5.1 | NFAT5 | 0.0010 | 0.82 |
| MYRIP.2 | MYRIP | 0.0002 | 0.75 |
| MYH11.1 | MYH11 | <0.0001 | 0.61 |
| cMYC.3 | MYC | 0.0002 | 0.79 |
| MVP.1 | MVP | 0.0052 | 0.83 |
| MUC1.2 | MUC1 | 0.0405 | 0.87 |
| FRAP1.1 | MTOR | <0.0001 | 0.75 |
| MSH3.2 | MSH3 | <0.0001 | 0.75 |
| MSH2.3 | MSH2 | <0.0001 | 0.71 |
| GBL.1 | MLST8 | 0.0246 | 0.87 |
| MIF.2 | MIF | 0.0012 | 0.80 |
| MICA.1 | MICA | <0.0001 | 0.71 |
| MGMT.1 | MGMT | <0.0001 | 0.68 |
| MCM3.3 | MCM3 | 0.0188 | 0.85 |
| MCAM.1 | MCAM | <0.0001 | 0.71 |
| MARCKS.1 | MARCKS | 0.0301 | 0.87 |
| ERK1.3 | MAPK3 | <0.0001 | 0.65 |
| ERK2.3 | MAPK1 | 0.0005 | 0.79 |
| MAP4.1 | MAP4 | <0.0001 | 0.65 |
| MAP2K3.1 | MAP2K3 | <0.0001 | 0.69 |
| MAP2K1.1 | MAP2K1 | 0.0046 | 0.83 |
| MAL2.1 | MAL2 | 0.0001 | 0.76 |
| MAL.1 | MAL | <0.0001 | 0.66 |
| LYZ.1 | LYZ | 0.0458 | 0.88 |
| LTF.1 | LTF | 0.0005 | 0.76 |
| LRP2.1 | LRP2 | <0.0001 | 0.67 |
| LMO2.1 | LMO2 | <0.0001 | 0.74 |
| LDB2.1 | LDB2 | <0.0001 | 0.52 |
| LDB1.2 | LDB1 | <0.0001 | 0.71 |
| LAMA4.1 | LAMA4 | 0.0279 | 0.86 |
| KRT7.1 | KRT7 | <0.0001 | 0.68 |
| K-ras.10 | KRAS | <0.0001 | 0.72 |
| KL.1 | KL | <0.0001 | 0.55 |
| Kitlng.4 | KITLG | <0.0001 | 0.67 |
| c-kit.2 | KIT | <0.0001 | 0.72 |
| KDR.6 | KDR | <0.0001 | 0.54 |
| KCNJ15.1 | KCNJ15 | <0.0001 | 0.63 |
| HTATIP.1 | KAT5 | <0.0001 | 0.64 |
| G-Catenin.1 | JUP | <0.0001 | 0.64 |
| AP-1 (JUN official).2 | JUN | 0.0001 | 0.76 |
| JAG1.1 | JAG1 | <0.0001 | 0.55 |
| ITGB1.1 | ITGB1 | 0.0085 | 0.83 |
| ITGA7.1 | ITGA7 | <0.0001 | 0.66 |
| ITGA6.2 | ITGA6 | <0.0001 | 0.63 |
| ITGA4.2 | ITGA4 | <0.0001 | 0.74 |
| ITGA3.2 | ITGA3 | 0.0002 | 0.79 |
| IQGAP2.1 | IQGAP2 | <0.0001 | 0.69 |
| INSR.1 | INSR | <0.0001 | 0.67 |
| IMP3.1 | IMP3 | <0.0001 | 0.69 |
| IL6ST.3 | IL6ST | <0.0001 | 0.66 |
| IL15.1 | IL15 | <0.0001 | 0.70 |
| IGFBP6.1 | IGFBP6 | 0.0004 | 0.79 |
| IGFBP3.1 | IGFBP3 | 0.0394 | 0.87 |
| IGFBP2.1 | IGFBP2 | 0.0134 | 0.84 |
| IGF1R.3 | IGF1R | <0.0001 | 0.58 |
| IFI27.1 | IFI27 | 0.0205 | 0.85 |
| ID3.1 | ID3 | <0.0001 | 0.69 |
| ID2.4 | ID2 | <0.0001 | 0.75 |
| ID1.1 | ID1 | <0.0001 | 0.55 |
| ICAM2.1 | ICAM2 | <0.0001 | 0.64 |
| HYAL2.1 | HYAL2 | <0.0001 | 0.60 |
| HYAL1.1 | HYAL1 | <0.0001 | 0.58 |
| HSPG2.1 | HSPG2 | <0.0001 | 0.60 |
| HSD11B2.1 | HSD11B2 | <0.0001 | 0.63 |
| Hepsin.1 | HPN | 0.0001 | 0.76 |
| HPCAL1.1 | HPCAL1 | 0.0031 | 0.82 |
| HMGB1.1 | HMGB1 | <0.0001 | 0.67 |
| HLA-DPB1.1 | HLA-DPB1 | <0.0001 | 0.70 |
| HIF1AN.1 | HIF1AN | <0.0001 | 0.77 |
| HDAC1.1 | HDAC1 | 0.0003 | 0.78 |
| HAVCR1.1 | HAVCR1 | 0.0003 | 0.79 |
| HADH.1 | HADH | <0.0001 | 0.68 |
| GZMA.1 | GZMA | 0.0125 | 0.84 |
| GSTp.3 | GSTP1 | <0.0001 | 0.76 |
| GSTM3.2 | GSTM3 | <0.0001 | 0.70 |
| GSTM1.1 | GSTM1 | <0.0001 | 0.72 |
| GRB7.2 | GRB7 | <0.0001 | 0.74 |
| GPX3.1 | GPX3 | <0.0001 | 0.75 |
| GJA1.1 | GJA1 | 0.0049 | 0.84 |
| GFRA1.1 | GFRA1 | 0.0003 | 0.77 |
| GCLC.3 | GCLC | <0.0001 | 0.68 |
| GBP2.2 | GBP2 | 0.0156 | 0.85 |
| GATM.1 | GATM | <0.0001 | 0.66 |
| GATA3.3 | GATA3 | 0.0001 | 0.75 |
| FOS.1 | FOS | <0.0001 | 0.74 |
| FOLR1.1 | FOLR1 | 0.0003 | 0.79 |
| FLT4.1 | FLT4 | <0.0001 | 0.54 |
| FLT3LG.1 | FLT3LG | 0.0001 | 0.73 |
| FLT1.1 | FLT1 | <0.0001 | 0.59 |
| FILIP1.1 | FILIP1 | <0.0001 | 0.72 |
| FIGF.1 | FIGF | 0.0014 | 0.76 |
| FHL1.1 | FHL1 | <0.0001 | 0.68 |
| FHIT.1 | FHIT | <0.0001 | 0.73 |
| FH.1 | FH | <0.0001 | 0.73 |
| FGFR2 isoform | FGFR2 | <0.0001 | 0.70 |

TABLE 3a-continued

Genes for which increased expression is associated with lower risk of cancer recurrence (p-value ≤ .05)

| Gene | Official Symbol | Univariate Cox Analyses (No Covariate Adjustment) with RFI | |
|---|---|---|---|
| | | p-value for HR | HR |
| 1.1 | | | |
| FGFR1.3 | FGFR1 | 0.0001 | 0.77 |
| FGF2.2 | FGF2 | <0.0001 | 0.73 |
| FGF1.1 | FGF1 | 0.0015 | 0.78 |
| FDPS.1 | FDPS | <0.0001 | 0.69 |
| FBXW7.1 | FBXW7 | 0.0001 | 0.75 |
| fas.1 | FAS | <0.0001 | 0.73 |
| FABP1.1 | FABP1 | 0.0455 | 0.86 |
| ESRRG.3 | ESRRG | 0.0008 | 0.79 |
| ERG.1 | ERG | <0.0001 | 0.60 |
| ERCC1.2 | ERCC1 | <0.0001 | 0.78 |
| ErbB3.1 | ERBB3 | 0.0001 | 0.77 |
| HER2.3 | ERBB2 | <0.0001 | 0.65 |
| EPHB4.1 | EPHB4 | <0.0001 | 0.64 |
| EPHA2.1 | EPHA2 | <0.0001 | 0.58 |
| EPAS1.1 | EPAS1 | <0.0001 | 0.55 |
| ENPP2.1 | ENPP2 | 0.0090 | 0.84 |
| ENPEP.1 | ENPEP | <0.0001 | 0.74 |
| CD105.1 | ENG | <0.0001 | 0.60 |
| EMP1.1 | EMP1 | <0.0001 | 0.71 |
| EMCN.1 | EMCN | <0.0001 | 0.43 |
| ELTD1.1 | ELTD1 | <0.0001 | 0.76 |
| EIF2C1.1 | EIF2C1 | <0.0001 | 0.67 |
| EGR1.1 | EGR1 | <0.0001 | 0.72 |
| EGLN3.1 | EGLN3 | 0.0002 | 0.80 |
| EGFR.2 | EGFR | 0.0005 | 0.80 |
| EFNB2.1 | EFNB2 | <0.0001 | 0.64 |
| EFNB1.2 | EFNB1 | <0.0001 | 0.68 |
| EEF1A1.1 | EEF1A1 | <0.0001 | 0.64 |
| EDNRB.1 | EDNRB | <0.0001 | 0.56 |
| EDN2.1 | EDN2 | 0.0005 | 0.77 |
| EDN1 endothelin.1 | EDN1 | <0.0001 | 0.62 |
| EBAG9.1 | EBAG9 | 0.0041 | 0.82 |
| DUSP1.1 | DUSP1 | 0.0029 | 0.82 |
| DPYS.1 | DPYS | 0.0112 | 0.84 |
| DPEP1.1 | DPEP1 | <0.0001 | 0.64 |
| DLL4.1 | DLL4 | <0.0001 | 0.76 |
| DLC1.1 | DLC1 | <0.0001 | 0.55 |
| DKFZP564O08 23.1 | DKFZP564O 0823 | <0.0001 | 0.62 |
| DICER1.2 | DICER1 | <0.0001 | 0.71 |
| DIAPH1.1 | DIAPH1 | 0.0009 | 0.80 |
| DIABLO.1 | DIABLO | 0.0134 | 0.84 |
| DHPS.3 | DHPS | <0.0001 | 0.70 |
| DET1.1 | DET1 | <0.0001 | 0.74 |
| DEFB1.1 | DEFB1 | 0.0025 | 0.81 |
| DDC.1 | DDC | <0.0001 | 0.68 |
| DCXR.1 | DCXR | 0.0081 | 0.83 |
| DAPK1.3 | DAPK1 | <0.0001 | 0.60 |
| CYR61.1 | CYR61 | <0.0001 | 0.70 |
| CYP3A4.2 | CYP3A4 | 0.0380 | 0.86 |
| CXCL9.1 | CXCL9 | 0.0362 | 0.87 |
| CXCL12.1 | CXCL12 | <0.0001 | 0.69 |
| CX3CR1.1 | CX3CR1 | <0.0001 | 0.72 |
| CX3CL1.1 | CX3CL1 | <0.0001 | 0.58 |
| CUL1.1 | CUL1 | 0.0003 | 0.80 |
| CUBN.1 | CUBN | <0.0001 | 0.61 |
| CTSS.1 | CTSS | 0.0016 | 0.82 |
| CTSH.2 | CTSH | <0.0001 | 0.78 |
| B-Catenin.3 | CTNNB1 | <0.0001 | 0.74 |
| A-Catenin.2 | CTNNA1 | <0.0001 | 0.77 |
| CTGF.1 | CTGF | 0.0004 | 0.79 |
| CSF1R.2 | CSF1R | 0.0015 | 0.82 |
| CSF1.1 | CSF1 | 0.0016 | 0.81 |
| CRADD | CRADD | 0.0021 | 0.81 |
| COL4A2.1 | COL4A2 | 0.0016 | 0.80 |
| COL18A1.1 | COL18A1 | 0.0007 | 0.79 |
| CLU.3 | CLU | 0.0151 | 0.85 |
| CLDN7.2 | CLDN7 | 0.0023 | 0.81 |
| CLDN10.1 | CLDN10 | <0.0001 | 0.69 |
| CLCNKB.1 | CLCNKB | 0.0002 | 0.74 |
| CFLAR.1 | CFLAR | <0.0001 | 0.65 |
| CEACAM1.1 | CEACAM1 | <0.0001 | 0.59 |
| p27.3 | CDKN1B | 0.0018 | 0.83 |
| p21.3 | CDKN1A | 0.0027 | 0.81 |
| CDH6.1 | CDH6 | <0.0001 | 0.75 |
| CDH5.1 | CDH5 | <0.0001 | 0.59 |
| CDH16.1 | CDH16 | <0.0001 | 0.75 |
| CDH13.1 | CDH13 | <0.0001 | 0.66 |
| CD4.1 | CD4 | 0.0009 | 0.81 |
| CD36.1 | CD36 | <0.0001 | 0.65 |
| CD34.1 | CD34 | <0.0001 | 0.62 |
| CCR7.1 | CCR7 | 0.0271 | 0.86 |
| CCR4.2 | CCR4 | 0.0106 | 0.83 |
| CCND1.3 | CCND1 | <0.0001 | 0.70 |
| CCL4.2 | CCL4 | 0.0012 | 0.80 |
| MCP1.1 | CCL2 | <0.0001 | 0.75 |
| CAT.1 | CAT | <0.0001 | 0.72 |
| CASP6.1 | CASP6 | 0.0369 | 0.87 |
| CASP10.1 | CASP10 | <0.0001 | 0.69 |
| CALD1.2 | CALD1 | <0.0001 | 0.61 |
| CA9.3 | CA9 | 0.0035 | 0.84 |
| CA2.1 | CA2 | 0.0006 | 0.79 |
| C7.1 | C7 | 0.0030 | 0.82 |
| ECRG4.1 | C2orf40 | <0.0001 | 0.57 |
| C13orf15.1 | C13orf15 | <0.0001 | 0.57 |
| BUB3.1 | BUB3 | 0.0002 | 0.77 |
| BTRC.1 | BTRC | 0.0006 | 0.81 |
| CIAP1.2 | BIRC2 | 0.0030 | 0.82 |
| BIN1.3 | BIN1 | 0.0005 | 0.80 |
| BGN.1 | BGN | <0.0001 | 0.76 |
| BCL2L12.1 | BCL2L12 | 0.0322 | 0.86 |
| Bclx.2 | BCL2L1 | <0.0001 | 0.74 |
| Bcl2.2 | BCL2 | <0.0001 | 0.57 |
| BBC3.2 | BBC3 | 0.0449 | 0.87 |
| BAG1.2 | BAG1 | <0.0001 | 0.64 |
| BAD.1 | BAD | 0.0076 | 0.85 |
| ATP6V1B1.1 | ATP6V1B1 | 0.0001 | 0.71 |
| ASS1.1 | ASS1 | <0.0001 | 0.75 |
| ARRB1.1 | ARRB1 | <0.0001 | 0.62 |
| ARHGDIB.1 | ARHGDIB | <0.0001 | 0.66 |
| AQP1.1 | AQP1 | <0.0001 | 0.50 |
| APOLD1.1 | APOLD1 | <0.0001 | 0.57 |
| APC.4 | APC | <0.0001 | 0.73 |
| ANXA4.1 | ANXA4 | 0.0018 | 0.81 |
| ANXA1.2 | ANXA1 | 0.0009 | 0.80 |
| ANTXR1.1 | ANTXR1 | 0.0043 | 0.82 |
| ANGPTL4.1 | ANGPTL4 | 0.0033 | 0.84 |
| ANGPTL3.3 | ANGPTL3 | 0.0003 | 0.75 |
| ANGPT1.1 | ANGPT1 | <0.0001 | 0.57 |
| ALDOB.1 | ALDOB | <0.0001 | 0.62 |
| ALDH6A1.1 | ALDH6A1 | <0.0001 | 0.63 |
| ALDH4.2 | ALDH4A1 | 0.0172 | 0.85 |
| AKT3.2 | AKT3 | <0.0001 | 0.57 |
| AKT2.3 | AKT2 | <0.0001 | 0.75 |
| AKT1.3 | AKT1 | <0.0001 | 0.71 |
| AIF1.1 | AIF1 | 0.0349 | 0.87 |
| AHR.1 | AHR | <0.0001 | 0.74 |
| AGTR1.1 | AGTR1 | <0.0001 | 0.57 |
| ADH1B.1 | ADH1B | 0.0002 | 0.77 |
| ADFP.1 | ADFP | 0.0332 | 0.88 |
| ADD1.1 | ADD1 | <0.0001 | 0.58 |
| ADAMTS5.1 | ADAMTS5 | 0.0010 | 0.78 |
| ADAMTS1.1 | ADAMTS1 | 0.0056 | 0.83 |
| ACE2.1 | ACE2 | <0.0001 | 0.62 |
| ACADSB.1 | ACADSB | <0.0001 | 0.71 |
| BCRP.1 | ABCG2 | <0.0001 | 0.58 |
| MRP4.2 | ABCC4 | <0.0001 | 0.74 |
| MRP3.1 | ABCC3 | 0.0107 | 0.85 |
| MRP1.1 | ABCC1 | <0.0001 | 0.75 |
| ABCB1.5 | ABCB1 | 0.0093 | 0.84 |

TABLE 3a-continued

Genes for which increased expression is associated with lower risk of cancer recurrence (p-value ≤ .05)

| Gene | Official Symbol | Univariate Cox Analyses (No Covariate Adjustment) with RFI | |
|---|---|---|---|
| | | p-value for HR | HR |
| NPD009 (ABAT official).3 | ABAT | 0.0001 | 0.76 |
| AAMP.1 | AAMP | 0.0008 | 0.80 |
| A2M.1 | A2M | <0.0001 | 0.56 |

TABLE 3b

Genes for which increased expression is associated with higher risk of cancer recurrence (p-value ≤ .05)

| Gene | Official Symbol | Univariate Cox Analyses (No Covariate Adjustment) with RFI | |
|---|---|---|---|
| | | p-value for HR | HR |
| WT1.1 | WT1 | 0.0002 | 1.25 |
| VTN.1 | VTN | 0.0097 | 1.17 |
| VDR.2 | VDR | 0.0031 | 1.22 |
| VCAN.1 | VCAN | 0.0036 | 1.22 |
| UBE2T.1 | UBE2T | <0.0001 | 1.38 |
| C20 orf1.1 | TPX2 | <0.0001 | 1.76 |
| TOP2A.4 | TOP2A | <0.0001 | 1.39 |
| TK1.2 | TK1 | 0.0018 | 1.22 |
| TIMP1.1 | TIMP1 | 0.0259 | 1.16 |
| TGFBI.1 | TGFBI | 0.0004 | 1.26 |
| SQSTM1.1 | SQSTM1 | 0.0089 | 1.20 |
| OPN, osteopontin.3 | SPP1 | <0.0001 | 1.43 |
| SPHK1.1 | SPHK1 | 0.0025 | 1.22 |
| SLC7A5.2 | SLC7A5 | <0.0001 | 1.38 |
| SLC2A1.1 | SLC2A1 | 0.0010 | 1.26 |
| SLC16A3.1 | SLC16A3 | <0.0001 | 1.38 |
| SLC13A3.1 | SLC13A3 | 0.0192 | 1.16 |
| SHC1.1 | SHC1 | 0.0086 | 1.19 |
| SFN.1 | SFN | 0.0001 | 1.26 |
| SERPINA5.1 | SERPINA5 | 0.0462 | 1.13 |
| SEMA3C.1 | SEMA3C | <0.0001 | 1.45 |
| SAA2.2 | SAA2 | <0.0001 | 1.59 |
| S100A1.1 | S100A1 | 0.0348 | 1.16 |
| RRM2.1 | RRM2 | 0.0002 | 1.27 |
| RPLP1.1 | RPLP1 | 0.0049 | 1.22 |
| PTTG1.2 | PTTG1 | <0.0001 | 1.45 |
| COX2.1 | PTGS2 | 0.0013 | 1.22 |
| PLAUR.3 | PLAUR | <0.0001 | 1.33 |
| PF4.1 | PF4 | 0.0034 | 1.20 |
| PCSK6.1 | PCSK6 | 0.0269 | 1.17 |
| MYBL2.1 | MYBL2 | <0.0001 | 1.33 |
| MT1X.1 | MT1X | 0.0070 | 1.20 |
| MMP9.1 | MMP9 | <0.0001 | 1.54 |
| MMP7.1 | MMP7 | 0.0312 | 1.15 |
| MMP14.1 | MMP14 | <0.0001 | 1.47 |
| Ki-67.2 | MKI67 | <0.0001 | 1.33 |
| mGST1.2 | MGST1 | <0.0001 | 1.38 |
| MDK.1 | MDK | 0.0001 | 1.31 |
| LOX.1 | LOX | <0.0001 | 1.42 |
| LMNB1.1 | LMNB1 | <0.0001 | 1.40 |
| LIMK1.1 | LIMK1 | <0.0001 | 1.43 |
| LGALS1.1 | LGALS1 | 0.0017 | 1.25 |
| LAMB3.1 | LAMB3 | <0.0001 | 1.34 |
| LAMB1.1 | LAMB1 | 0.0014 | 1.25 |
| L1CAM.1 | L1CAM | 0.0199 | 1.16 |
| IL-8.1 | IL8 | <0.0001 | 1.53 |
| IL6.3 | IL6 | <0.0001 | 1.41 |
| ICAM1.1 | ICAM1 | 0.0013 | 1.23 |
| HIST1H1D.1 | HIST1H1D | 0.0066 | 1.21 |
| FN1.1 | FN1 | 0.0105 | 1.19 |

TABLE 3b-continued

Genes for which increased expression is associated with higher risk of cancer recurrence (p-value ≤ .05)

| Gene | Official Symbol | Univariate Cox Analyses (No Covariate Adjustment) with RFI | |
|---|---|---|---|
| | | p-value for HR | HR |
| F3.1 | F3 | <0.0001 | 1.31 |
| F2.1 | F2 | <0.0001 | 1.30 |
| ESPL1.3 | ESPL1 | 0.0155 | 1.17 |
| EPHB2.1 | EPHB2 | 0.0456 | 1.14 |
| EPHB1.3 | EPHB1 | 0.0007 | 1.22 |
| ENO2.1 | ENO2 | <0.0001 | 1.38 |
| EIF4EBP1.1 | EIF4EBP1 | 0.0098 | 1.19 |
| CXCR4.3 | CXCR4 | 0.0066 | 1.21 |
| GRO1.2 | CXCL1 | <0.0001 | 1.30 |
| CTSB.1 | CTSB | 0.0233 | 1.17 |
| CRP.1 | CRP | 0.0314 | 1.13 |
| CP.1 | CP | 0.0002 | 1.32 |
| COL7A1.1 | COL7A1 | 0.0003 | 1.24 |
| COL1A1.1 | COL1A1 | 0.0029 | 1.23 |
| Chk1.2 | CHEK1 | 0.0002 | 1.26 |
| CENPF.1 | CENPF | <0.0001 | 1.36 |
| CD82.3 | CD82 | 0.0009 | 1.25 |
| CD44s.1 | CD44_s | 0.0065 | 1.21 |
| CCNE1.1 | CCNE1 | 0.0098 | 1.17 |
| CCNB1.2 | CCNB1 | <0.0001 | 1.42 |
| CCL20.1 | CCL20 | 0.0029 | 1.22 |
| CA12.1 | CA12 | <0.0001 | 1.48 |
| C3.1 | C3 | 0.0176 | 1.18 |
| BUB1.1 | BUB1 | <0.0001 | 1.59 |
| SURV.2 | BIRC5 | <0.0001 | 1.37 |
| cIAP2.2 | BIRC3 | 0.0484 | 1.15 |
| BCL2A1.1 | BCL2A1 | 0.0483 | 1.11 |
| STK15.2 | AURKA | 0.0002 | 1.28 |
| ANXA2.2 | ANXA2 | 0.0315 | 1.16 |
| ALOX5.1 | ALOX5 | 0.0473 | 1.14 |
| ADAM8.1 | ADAM8 | 0.0002 | 1.29 |
| MRP2.3 | ABCC2 | 0.0004 | 1.28 |

TABLE 4a

Proxy genes for which increased expression is associated with higher tumor stage (p-value ≤ .05)

| Gene | Official Symbol | Stage 3 vs. 1 | |
|---|---|---|---|
| | | p-value | OR |
| WT1.1 | WT1 | <0.0001 | 1.41 |
| VTN.1 | VTN | 0.0007 | 1.29 |
| VDR.2 | VDR | 0.0065 | 1.25 |
| UBE2T.1 | UBE2T | <0.0001 | 1.61 |
| TSPAN8.1 | TSPAN8 | 0.0072 | 1.23 |
| C20 orf1.1 | TPX2 | <0.0001 | 1.89 |
| TOP2A.4 | TOP2A | <0.0001 | 1.55 |
| TK1.2 | TK1 | 0.0001 | 1.34 |
| TIMP1.1 | TIMP1 | 0.0021 | 1.29 |
| TGFBI.1 | TGFBI | 0.0001 | 1.39 |
| OPN, osteopontin.3 | SPP1 | 0.0001 | 1.38 |
| SLC7A5.2 | SLC7A5 | <0.0001 | 1.51 |
| SLC2A1.1 | SLC2A1 | 0.0081 | 1.24 |
| SLC16A3.1 | SLC16A3 | <0.0001 | 1.46 |
| SFN.1 | SFN | 0.0001 | 1.36 |
| SEMA3C.1 | SEMA3C | <0.0001 | 1.42 |
| SELL.1 | SELL | 0.0313 | 1.19 |
| SAA2.2 | SAA2 | <0.0001 | 2.04 |
| RRM2.1 | RRM2 | <0.0001 | 1.47 |
| RPLP1.1 | RPLP1 | 0.0007 | 1.33 |
| RAD51.1 | RAD51 | 0.0010 | 1.31 |
| PTTG1.2 | PTTG1 | <0.0001 | 1.61 |
| COX2.1 | PTGS2 | 0.0011 | 1.29 |
| PTGIS.1 | PTGIS | 0.0034 | 1.27 |
| PLAUR.3 | PLAUR | <0.0001 | 1.51 |

TABLE 4a-continued

Proxy genes for which increased expression is associated with higher tumor stage (p-value ≤ .05)

| Gene | Official Symbol | Stage 3 vs. 1 p-value | OR |
|---|---|---|---|
| PF4.1 | PF4 | 0.0027 | 1.26 |
| PDGFRa.2 | PDGFRA | 0.0480 | 1.17 |
| PCSK6.1 | PCSK6 | 0.0041 | 1.27 |
| NNMT.1 | NNMT | 0.0003 | 1.34 |
| NME2.1 | NME2 | 0.0028 | 1.28 |
| MYBL2.1 | MYBL2 | <0.0001 | 1.50 |
| MT1X.1 | MT1X | 0.0192 | 1.21 |
| MMP9.1 | MMP9 | <0.0001 | 1.79 |
| MMP7.1 | MMP7 | 0.0252 | 1.20 |
| MMP14.1 | MMP14 | <0.0001 | 1.88 |
| Ki-67.2 | MKI67 | <0.0001 | 1.48 |
| mGST1.2 | MGST1 | 0.0004 | 1.37 |
| MDK.1 | MDK | <0.0001 | 1.42 |
| MDH2.1 | MDH2 | 0.0321 | 1.19 |
| LRRC2.1 | LRRC2 | 0.0259 | 1.19 |
| LOX.1 | LOX | <0.0001 | 1.78 |
| LMNB1.1 | LMNB1 | <0.0001 | 1.82 |
| LIMK1.1 | LIMK1 | <0.0001 | 1.46 |
| LAPTM5.1 | LAPTM5 | 0.0102 | 1.23 |
| LAMB3.1 | LAMB3 | <0.0001 | 1.53 |
| LAMB1.1 | LAMB1 | 0.0452 | 1.18 |
| LAMA3.1 | LAMA3 | 0.0121 | 1.22 |
| L1CAM.1 | L1CAM | 0.0091 | 1.22 |
| ISG20.1 | ISG20 | 0.0006 | 1.34 |
| IL-8.1 | IL8 | <0.0001 | 1.89 |
| IL6.3 | IL6 | <0.0001 | 1.68 |
| IGF1.2 | IGF1 | 0.0214 | 1.20 |
| ICAM1.1 | ICAM1 | <0.0001 | 1.42 |
| HIST1H1D.1 | HIST1H1D | 0.0005 | 1.33 |
| GPX2.2 | GPX2 | 0.0129 | 1.22 |
| FN1.1 | FN1 | 0.0002 | 1.36 |
| FAP.1 | FAP | 0.0455 | 1.18 |
| F3.1 | F3 | <0.0001 | 1.52 |
| F2.1 | F2 | <0.0001 | 1.79 |
| ESPL1.3 | ESPL1 | 0.0001 | 1.35 |
| EPB41L3.1 | EPB41L3 | 0.0067 | 1.24 |
| ENO2.1 | ENO2 | 0.0016 | 1.31 |
| EIF4EBP1.1 | EIF4EBP1 | 0.0036 | 1.27 |
| E2F1.3 | E2F1 | 0.0017 | 1.27 |
| DCN.1 | DCN | 0.0152 | 1.22 |
| CXCR6.1 | CXCR6 | 0.0013 | 1.30 |
| BLR1.1 | CXCR5 | 0.0232 | 1.19 |
| CXCR4.3 | CXCR4 | 0.0003 | 1.35 |
| GRO1.2 | CXCL1 | 0.0005 | 1.31 |
| CTSB.1 | CTSB | 0.0110 | 1.24 |
| CRP.1 | CRP | 0.0002 | 1.31 |
| CP.1 | CP | 0.0008 | 1.34 |
| COL7A1.1 | COL7A1 | 0.0010 | 1.28 |
| COL1A1.1 | COL1A1 | 0.0001 | 1.40 |
| Chk2.3 | CHEK2 | 0.0050 | 1.27 |
| Chk1.2 | CHEK1 | <0.0001 | 1.43 |
| CENPF.1 | CENPF | <0.0001 | 1.55 |
| CD82.3 | CD82 | 0.0001 | 1.38 |
| CD44s.1 | CD44_s | 0.0060 | 1.25 |
| CCNE2.2 | CCNE2_2 | 0.0229 | 1.19 |
| CCNB1.2 | CCNB1 | <0.0001 | 1.60 |
| CCL20.1 | CCL20 | 0.0010 | 1.30 |
| CA12.1 | CA12 | <0.0001 | 1.66 |
| C3.1 | C3 | 0.0009 | 1.32 |
| BUB1.1 | BUB1 | <0.0001 | 1.82 |
| SURV.2 | BIRC5 | <0.0001 | 1.46 |
| BCL2A1.1 | BCL2A1 | <0.0001 | 1.44 |
| STK15.2 | AURKA | 0.0002 | 1.36 |
| APOL1.1 | APOL1 | 0.0028 | 1.27 |
| ANXA2.2 | ANXA2 | 0.0174 | 1.21 |
| ADAM8.1 | ADAM8 | <0.0001 | 1.58 |
| MRP2.3 | ABCC2 | <0.0001 | 1.45 |

TABLE 4b

Proxy genes for which increased expression is associated with lower tumor stage (p-value ≤ .05)

| Gene | Official Symbol | Stage 3 vs. 1 p-value | OR |
|---|---|---|---|
| YB-1.2 | YBX1 | <0.0001 | 0.63 |
| XIAP.1 | XIAP | <0.0001 | 0.62 |
| WWOX.5 | WWOX | 0.0042 | 0.79 |
| WISP1.1 | WISP1 | 0.0096 | 0.81 |
| VWF.1 | VWF | <0.0001 | 0.46 |
| VEGF.1 | VEGFA | <0.0001 | 0.63 |
| VCAM1.1 | VCAM1 | <0.0001 | 0.55 |
| USP34.1 | USP34 | 0.0001 | 0.72 |
| UMOD.1 | UMOD | <0.0001 | 0.47 |
| UGCG.1 | UGCG | <0.0001 | 0.68 |
| UBB.1 | UBB | <0.0001 | 0.54 |
| UBE1C.1 | UBA3 | <0.0001 | 0.62 |
| TS.1 | TYMS | 0.0010 | 0.76 |
| tusc4.2 | TUSC4 | <0.0001 | 0.57 |
| TUSC2.1 | TUSC2 | 0.0295 | 0.83 |
| TSPAN7.2 | TSPAN7 | <0.0001 | 0.35 |
| TSC2.1 | TSC2 | <0.0001 | 0.66 |
| TSC1.1 | TSC1 | <0.0001 | 0.56 |
| P53.2 | TP53 | <0.0001 | 0.67 |
| TOP2B.2 | TOP2B | <0.0001 | 0.69 |
| TNIP2.1 | TNIP2 | 0.0359 | 0.85 |
| TNFSF12.1 | TNFSF12 | <0.0001 | 0.50 |
| TRAIL.1 | TNFSF10 | 0.0011 | 0.77 |
| TNFRSF11B.1 | TNFRSF11B | <0.0001 | 0.63 |
| TNFRSF10D.1 | TNFRSF10D | <0.0001 | 0.57 |
| DR5.2 | TNFRSF10B | <0.0001 | 0.64 |
| TNFAIP6.1 | TNFAIP6 | 0.0001 | 0.74 |
| TNF.1 | TNF | 0.0138 | 0.80 |
| TMEM47.1 | TMEM47 | <0.0001 | 0.41 |
| TMEM27.1 | TMEM27 | <0.0001 | 0.53 |
| TLR3.1 | TLR3 | <0.0001 | 0.68 |
| TIMP3.3 | TIMP3 | <0.0001 | 0.39 |
| TIMP2.1 | TIMP2 | <0.0001 | 0.68 |
| THBS1.1 | THBS1 | <0.0001 | 0.65 |
| TGFBR2.3 | TGFBR2 | <0.0001 | 0.41 |
| TGFBR1.1 | TGFBR1 | <0.0001 | 0.59 |
| TGFB2.2 | TGFB2 | <0.0001 | 0.50 |
| TGFb1.1 | TGFB1 | <0.0001 | 0.67 |
| TGFA.2 | TGFA | <0.0001 | 0.63 |
| TEK.1 | TEK | <0.0001 | 0.34 |
| TCF4.1 | TCF4 | <0.0001 | 0.47 |
| TAP1.1 | TAP1 | 0.0017 | 0.77 |
| TAGLN.1 | TAGLN | 0.0001 | 0.72 |
| TACSTD2.1 | TACSTD2 | <0.0001 | 0.58 |
| SUCLG1.1 | SUCLG1 | <0.0001 | 0.56 |
| STK11.1 | STK11 | <0.0001 | 0.58 |
| STAT5B.2 | STAT5B | <0.0001 | 0.50 |
| STAT5A.1 | STAT5A | <0.0001 | 0.60 |
| STAT3.1 | STAT3 | 0.0001 | 0.72 |
| STAT1.3 | STAT1 | 0.0344 | 0.84 |
| SPRY1.1 | SPRY1 | <0.0001 | 0.57 |
| SPAST.1 | SPAST | 0.0142 | 0.82 |
| SPARCL1.1 | SPARCL1 | <0.0001 | 0.59 |
| SPARC.1 | SPARC | <0.0001 | 0.69 |
| SOD1.1 | SOD1 | 0.0245 | 0.83 |
| SNRK.1 | SNRK | <0.0001 | 0.35 |
| SNAI1.1 | SNAI1 | <0.0001 | 0.70 |
| MADH4.1 | SMAD4 | <0.0001 | 0.47 |
| MADH2.1 | SMAD2 | <0.0001 | 0.50 |
| SLC9A1.1 | SLC9A1 | 0.0207 | 0.82 |
| SLC34A1.1 | SLC34A1 | <0.0001 | 0.63 |
| SLC22A6.1 | SLC22A6 | 0.0010 | 0.76 |
| SKIL.1 | SKIL | <0.0001 | 0.64 |
| PTPNS1.1 | SIRPA | 0.0075 | 0.81 |
| SHANK3.1 | SHANK3 | <0.0001 | 0.37 |
| SGK.1 | SGK1 | <0.0001 | 0.55 |
| FRP1.3 | SFRP1 | 0.0156 | 0.82 |
| SEMA3F.3 | SEMA3F | <0.0001 | 0.50 |
| SELPLG.1 | SELPLG | 0.0022 | 0.78 |
| SELENBP1.1 | SELENBP1 | 0.0003 | 0.75 |
| SDPR.1 | SDPR | <0.0001 | 0.42 |
| SDHA.1 | SDHA | <0.0001 | 0.65 |
| SCNN1A.2 | SCNN1A | 0.0024 | 0.77 |

TABLE 4b-continued

Proxy genes for which increased expression is associated with lower tumor stage (p-value ≤ .05)

| Gene | Official Symbol | Stage 3 vs. 1 p-value | OR |
|---|---|---|---|
| SCN4B.1 | SCN4B | <0.0001 | 0.50 |
| S100A2.1 | S100A2 | 0.0008 | 0.75 |
| KIAA1303 raptor.1 | RPTOR | <0.0001 | 0.60 |
| RPS6KB1.3 | RPS6KB1 | <0.0001 | 0.60 |
| RPS6KA1.1 | RPS6KA1 | 0.0002 | 0.71 |
| RPS23.1 | RPS23 | 0.0002 | 0.73 |
| ROCK2.1 | ROCK2 | <0.0001 | 0.52 |
| ROCK1.1 | ROCK1 | <0.0001 | 0.37 |
| RIPK1.1 | RIPK1 | <0.0001 | 0.55 |
| rhoC.1 | RHOC | <0.0001 | 0.66 |
| RhoB.1 | RHOB | <0.0001 | 0.57 |
| ARHA.1 | RHOA | <0.0001 | 0.50 |
| RHEB.2 | RHEB | <0.0001 | 0.61 |
| RGS5.1 | RGS5 | <0.0001 | 0.37 |
| FLJ22655.1 | RERGL | <0.0001 | 0.33 |
| RB1.1 | RB1 | <0.0001 | 0.61 |
| RASSF1.1 | RASSF1 | 0.0002 | 0.75 |
| RARB.2 | RARB | <0.0001 | 0.37 |
| RALBP1.1 | RALBP1 | <0.0001 | 0.43 |
| RAF1.3 | RAF1 | <0.0001 | 0.59 |
| RAC1.3 | RAC1 | 0.0356 | 0.84 |
| PTPRG.1 | PTPRG | <0.0001 | 0.35 |
| PTPRB.1 | PTPRB | <0.0001 | 0.31 |
| PTN.1 | PTN | <0.0001 | 0.56 |
| PTK2.1 | PTK2 | <0.0001 | 0.45 |
| PTHR1.1 | PTH1R | <0.0001 | 0.45 |
| PTEN.2 | PTEN | <0.0001 | 0.51 |
| PSMB9.1 | PSMB9 | 0.0139 | 0.82 |
| PSMB8.1 | PSMB8 | 0.0243 | 0.83 |
| PSMA7.1 | PSMA7 | 0.0101 | 0.81 |
| PRSS8.1 | PRSS8 | 0.0025 | 0.78 |
| PRPS2.1 | PRPS2 | 0.0190 | 0.82 |
| PRKCH.1 | PRKCH | <0.0001 | 0.48 |
| PRKCD.2 | PRKCD | 0.0001 | 0.72 |
| PPP2CA.1 | PPP2CA | <0.0001 | 0.58 |
| PPARG.3 | PPARG | <0.0001 | 0.40 |
| PPAP2B.1 | PPAP2B | <0.0001 | 0.31 |
| PLG.1 | PLG | <0.0001 | 0.53 |
| PLAT.1 | PLAT | <0.0001 | 0.54 |
| PLA2G4C.1 | PLA2G4C | <0.0001 | 0.65 |
| PIK3CA.1 | PIK3CA | <0.0001 | 0.53 |
| PI3K.2 | PIK3C2B | <0.0001 | 0.40 |
| PFKP.1 | PFKP | 0.0124 | 0.82 |
| CD31.3 | PECAM1 | <0.0001 | 0.42 |
| PDZK3.1 | PDZK3 | 0.0003 | 0.72 |
| PDZK1.1 | PDZK1 | <0.0001 | 0.58 |
| PDGFRb.3 | PDGFRB | <0.0001 | 0.62 |
| PDGFD.2 | PDGFD | <0.0001 | 0.43 |
| PDGFC.3 | PDGFC | <0.0001 | 0.51 |
| PDGFB.3 | PDGFB | <0.0001 | 0.40 |
| PDGFA.3 | PDGFA | <0.0001 | 0.57 |
| PCK1.1 | PCK1 | <0.0001 | 0.60 |
| PCCA.1 | PCCA | <0.0001 | 0.58 |
| PARD6A.1 | PARD6A | 0.0042 | 0.79 |
| Pak1.2 | PAK1 | <0.0001 | 0.69 |
| PAH.1 | PAH | 0.0309 | 0.84 |
| OGG1.1 | OGG1 | 0.0024 | 0.78 |
| BFGF.3 | NUDT6 | <0.0001 | 0.46 |
| NPR1.1 | NPR1 | <0.0001 | 0.58 |
| NPM1.2 | NPM1 | <0.0001 | 0.65 |
| NOTCH3.1 | NOTCH3 | <0.0001 | 0.58 |
| NOTCH2.1 | NOTCH2 | <0.0001 | 0.64 |
| NOTCH1.1 | NOTCH1 | <0.0001 | 0.44 |
| NOS3.1 | NOS3 | <0.0001 | 0.44 |
| NOS2A.3 | NOS2 | <0.0001 | 0.49 |
| NOL3.1 | NOL3 | 0.0003 | 0.76 |
| NFX1.1 | NFX1 | <0.0001 | 0.50 |
| NFKBp50.3 | NFKB1 | <0.0001 | 0.59 |
| NFATC2.1 | NFATC2 | <0.0001 | 0.64 |
| NFAT5.1 | NFAT5 | <0.0001 | 0.65 |
| MYRIP.2 | MYRIP | 0.0004 | 0.72 |
| MYH11.1 | MYH11 | <0.0001 | 0.50 |
| cMYC.3 | MYC | <0.0001 | 0.70 |
| MX1.1 | MX1 | 0.0103 | 0.81 |
| MVP.1 | MVP | 0.0002 | 0.74 |
| MUC1.2 | MUC1 | 0.0005 | 0.75 |
| FRAP1.1 | MTOR | <0.0001 | 0.61 |
| MSH3.2 | MSH3 | <0.0001 | 0.60 |
| MSH2.3 | MSH2 | <0.0001 | 0.53 |
| STMY3.3 | MMP11 | 0.0034 | 0.79 |
| GBL.1 | MLST8 | 0.0011 | 0.77 |
| MIF.2 | MIF | 0.0008 | 0.76 |
| MICA.1 | MICA | <0.0001 | 0.70 |
| MGMT.1 | MGMT | <0.0001 | 0.60 |
| MCM3.3 | MCM3 | <0.0001 | 0.68 |
| MCAM.1 | MCAM | <0.0001 | 0.52 |
| MARCKS.1 | MARCKS | 0.0001 | 0.73 |
| ERK1.3 | MAPK3 | <0.0001 | 0.48 |
| ERK2.3 | MAPK1 | 0.0221 | 0.83 |
| MAP4.1 | MAP4 | <0.0001 | 0.63 |
| MAP2K3.1 | MAP2K3 | <0.0001 | 0.59 |
| MAP2K1.1 | MAP2K1 | 0.0002 | 0.74 |
| MAL2.1 | MAL2 | <0.0001 | 0.64 |
| MAL.1 | MAL | <0.0001 | 0.49 |
| LYZ.1 | LYZ | 0.0318 | 0.84 |
| LTF.1 | LTF | 0.0131 | 0.80 |
| LRP2.1 | LRP2 | <0.0001 | 0.63 |
| LMO2.1 | LMO2 | <0.0001 | 0.56 |
| LDB2.1 | LDB2 | <0.0001 | 0.41 |
| LDB1.2 | LDB1 | <0.0001 | 0.54 |
| LAMA4.1 | LAMA4 | 0.0004 | 0.75 |
| KRT7.1 | KRT7 | <0.0001 | 0.60 |
| K-ras.10 | KRAS | <0.0001 | 0.68 |
| KL.1 | KL | <0.0001 | 0.49 |
| KitIng.4 | KITLG | <0.0001 | 0.43 |
| c-kit.2 | KIT | <0.0001 | 0.60 |
| KDR.1 | KDR | <0.0001 | 0.36 |
| KCNJ15.1 | KCNJ15 | <0.0001 | 0.54 |
| HTATIP.1 | KAT5 | <0.0001 | 0.40 |
| G-Catenin.1 | JUP | <0.0001 | 0.42 |
| AP-1 (JUN official).2 | JUN | 0.0001 | 0.73 |
| JAG1.1 | JAG1 | <0.0001 | 0.42 |
| ITGB5.1 | ITGB5 | 0.0115 | 0.81 |
| ITGB1.1 | ITGB1 | <0.0001 | 0.64 |
| ITGA7.1 | ITGA7 | <0.0001 | 0.54 |
| ITGA6.2 | ITGA6 | <0.0001 | 0.51 |
| ITGA5.1 | ITGA5 | 0.0325 | 0.84 |
| ITGA4.2 | ITGA4 | <0.0001 | 0.54 |
| ITGA3.2 | ITGA3 | <0.0001 | 0.61 |
| IQGAP2.1 | IQGAP2 | <0.0001 | 0.63 |
| INSR.1 | INSR | <0.0001 | 0.59 |
| IMP3.1 | IMP3 | <0.0001 | 0.54 |
| IL-7.1 | IL7 | 0.0444 | 0.85 |
| IL6ST.3 | IL6ST | <0.0001 | 0.50 |
| IL15.1 | IL15 | <0.0001 | 0.67 |
| IGFBP6.1 | IGFBP6 | 0.0001 | 0.73 |
| IGFBP3.1 | IGFBP3 | 0.0191 | 0.83 |
| IGF1R.3 | IGF1R | <0.0001 | 0.48 |
| ID3.1 | ID3 | <0.0001 | 0.54 |
| ID2.4 | ID2 | 0.0008 | 0.77 |
| ID1.1 | ID1 | <0.0001 | 0.34 |
| ICAM2.1 | ICAM2 | <0.0001 | 0.58 |
| HYAL2.1 | HYAL2 | <0.0001 | 0.41 |
| HYAL1.1 | HYAL1 | <0.0001 | 0.44 |
| HSPG2.1 | HSPG2 | <0.0001 | 0.44 |
| HSD11B2.1 | HSD11B2 | <0.0001 | 0.47 |
| Hepsin.1 | HPN | 0.0031 | 0.79 |
| HPCAL1.1 | HPCAL1 | 0.0004 | 0.75 |
| HNRNPAB.3 | HNRNPAB | 0.0039 | 0.78 |
| HMGB1.1 | HMGB1 | <0.0001 | 0.46 |
| HLA-DPB1.1 | HLA-DPB1 | <0.0001 | 0.55 |
| HIF1AN.1 | HIF1AN | <0.0001 | 0.57 |
| HIF1A.3 | HIF1A | 0.0076 | 0.80 |
| HGF.4 | HGF | 0.0067 | 0.80 |

TABLE 4b-continued

Proxy genes for which increased expression is associated with lower tumor stage (p-value ≤ .05)

| Gene | Official Symbol | Stage 3 vs. 1 p-value | OR |
|---|---|---|---|
| HDAC1.1 | HDAC1 | <0.0001 | 0.61 |
| HAVCR1.1 | HAVCR1 | 0.0001 | 0.73 |
| HADH.1 | HADH | <0.0001 | 0.62 |
| GSTT1.3 | GSTT1 | 0.0112 | 0.82 |
| GSTp.3 | GSTP1 | <0.0001 | 0.64 |
| GSTM3.2 | GSTM3 | <0.0001 | 0.57 |
| GSTM1.1 | GSTM1 | <0.0001 | 0.55 |
| GRB7.2 | GRB7 | <0.0001 | 0.66 |
| GRB14.1 | GRB14 | 0.0123 | 0.81 |
| GPX3.1 | GPX3 | 0.0120 | 0.82 |
| GNAS.1 | GNAS | 0.0003 | 0.74 |
| GJA1.1 | GJA1 | 0.0034 | 0.79 |
| GFRA1.1 | GFRA1 | 0.0164 | 0.82 |
| GCLM.2 | GCLM | 0.0056 | 0.80 |
| GCLC.3 | GCLC | <0.0001 | 0.49 |
| GBP2.2 | GBP2 | 0.0388 | 0.84 |
| GATM.1 | GATM | <0.0001 | 0.59 |
| GATA3.3 | GATA3 | 0.0002 | 0.72 |
| FOS.1 | FOS | <0.0001 | 0.65 |
| FOLR1.1 | FOLR1 | <0.0001 | 0.65 |
| FLT4.1 | FLT4 | <0.0001 | 0.37 |
| FLT3LG.1 | FLT3LG | <0.0001 | 0.61 |
| FLT1.1 | FLT1 | <0.0001 | 0.40 |
| FILIP1.1 | FILIP1 | <0.0001 | 0.47 |
| FIGF.1 | FIGF | <0.0001 | 0.53 |
| FHL1.1 | FHL1 | <0.0001 | 0.52 |
| FHIT.1 | FHIT | <0.0001 | 0.54 |
| FH.1 | FH | <0.0001 | 0.67 |
| FGFR2 isoform 1.1 | FGFR2 | <0.0001 | 0.62 |
| FGFR1.3 | FGFR1 | <0.0001 | 0.63 |
| FGF2.2 | FGF2 | <0.0001 | 0.58 |
| FGF1.1 | FGF1 | <0.0001 | 0.66 |
| FDPS.1 | FDPS | <0.0001 | 0.47 |
| FBXW7.1 | FBXW7 | <0.0001 | 0.66 |
| fas.1 | FAS | <0.0001 | 0.66 |
| ESRRG.3 | ESRRG | 0.0001 | 0.72 |
| ERG.1 | ERG | <0.0001 | 0.44 |
| ERCC1.2 | ERCC1 | <0.0001 | 0.60 |
| ERBB4.3 | ERBB4 | 0.0018 | 0.74 |
| ErbB3.1 | ERBB3 | 0.0031 | 0.79 |
| HER2.3 | ERBB2 | <0.0001 | 0.53 |
| EPHB4.1 | EPHB4 | <0.0001 | 0.51 |
| EPHA2.1 | EPHA2 | <0.0001 | 0.40 |
| EPAS1.1 | EPAS1 | <0.0001 | 0.38 |
| ENPP2.1 | ENPP2 | 0.0001 | 0.72 |
| ENPEP.1 | ENPEP | <0.0001 | 0.65 |
| CD105.1 | ENG | <0.0001 | 0.38 |
| EMP1.1 | EMP1 | <0.0001 | 0.64 |
| EMCN.1 | EMCN | <0.0001 | 0.27 |
| ELTD1.1 | ELTD1 | <0.0001 | 0.67 |
| EIF2C1.1 | EIF2C1 | <0.0001 | 0.51 |
| EGR1.1 | EGR1 | <0.0001 | 0.59 |
| EGLN3.1 | EGLN3 | 0.0002 | 0.75 |
| EGFR.2 | EGFR | 0.0072 | 0.81 |
| EGF.3 | EGF | 0.0051 | 0.77 |
| EFNB2.1 | EFNB2 | <0.0001 | 0.45 |
| EFNB1.2 | EFNB1 | <0.0001 | 0.55 |
| EEF1A1.1 | EEF1A1 | <0.0001 | 0.55 |
| EDNRB.1 | EDNRB | <0.0001 | 0.44 |
| EDN2.1 | EDN2 | 0.0012 | 0.74 |
| EDN1 endothelin.1 | EDN1 | <0.0001 | 0.53 |
| EBAG9.1 | EBAG9 | 0.0240 | 0.83 |
| DUSP1.1 | DUSP1 | 0.0130 | 0.82 |
| DPYS.1 | DPYS | 0.0355 | 0.85 |
| DPEP1.1 | DPEP1 | <0.0001 | 0.66 |
| DLL4.1 | DLL4 | <0.0001 | 0.66 |
| DLC1.1 | DLC1 | <0.0001 | 0.42 |
| DKFZP564O08 23.1 | DKFZP564O0823 | <0.0001 | 0.51 |
| DICER.2 | DICER1 | <0.0001 | 0.50 |
| DIAPH1.1 | DIAPH1 | 0.0219 | 0.83 |
| DIABLO.1 | DIABLO | 0.0022 | 0.78 |
| DHPS.3 | DHPS | <0.0001 | 0.55 |
| DET1.1 | DET1 | 0.0005 | 0.74 |
| DEFB1.1 | DEFB1 | 0.0002 | 0.73 |
| DDC.1 | DDC | <0.0001 | 0.72 |
| DAPK1.3 | DAPK1 | <0.0001 | 0.42 |
| CYR61.1 | CYR61 | <0.0001 | 0.59 |
| CXCL12.1 | CXCL12 | <0.0001 | 0.62 |
| CX3CR1.1 | CX3CR1 | <0.0001 | 0.46 |
| CX3CL1.1 | CX3CL1 | <0.0001 | 0.47 |
| CUL1.1 | CUL1 | <0.0001 | 0.64 |
| CUBN.1 | CUBN | <0.0001 | 0.55 |
| CTSS.1 | CTSS | 0.0007 | 0.76 |
| CTSH.2 | CTSH | <0.0001 | 0.64 |
| B-Catenin.3 | CTNNB1 | <0.0001 | 0.54 |
| A-Catenin.2 | CTNNA1 | <0.0001 | 0.65 |
| CTGF.1 | CTGF | <0.0001 | 0.71 |
| CSF2RA.2 | CSF2RA | 0.0037 | 0.78 |
| CSF1R.2 | CSF1R | <0.0001 | 0.67 |
| CSF1.1 | CSF1 | <0.0001 | 0.65 |
| CRADD.1 | CRADD | 0.0032 | 0.79 |
| COL4A2.1 | COL4A2 | <0.0001 | 0.65 |
| COL4A1.1 | COL4A1 | 0.0067 | 0.80 |
| COL18A1.1 | COL18A1 | 0.0001 | 0.72 |
| CLU.3 | CLU | 0.0004 | 0.75 |
| CLDN10.1 | CLDN10 | <0.0001 | 0.65 |
| CLCNKB.1 | CLCNKB | <0.0001 | 0.52 |
| CFLAR.1 | CFLAR | <0.0001 | 0.60 |
| CEACAM1.1 | CEACAM1 | <0.0001 | 0.55 |
| p21.3 | CDKN1A | 0.0002 | 0.73 |
| CDH6.1 | CDH6 | <0.0001 | 0.72 |
| CDH5.1 | CDH5 | <0.0001 | 0.44 |
| CDH2.1 | CDH2 | 0.0392 | 0.85 |
| CDH16.1 | CDH16 | <0.0001 | 0.70 |
| CDH13.1 | CDH13 | <0.0001 | 0.53 |
| CDC25B.1 | CDC25B | 0.0037 | 0.79 |
| CD4.1 | CD4 | <0.0001 | 0.72 |
| CD36.1 | CD36 | <0.0001 | 0.51 |
| CD34.1 | CD34 | <0.0001 | 0.48 |
| CD24.1 | CD24 | 0.0206 | 0.83 |
| CD14.1 | CD14 | 0.0152 | 0.82 |
| CCND1.3 | CCND1 | <0.0001 | 0.51 |
| CCL4.2 | CCL4 | 0.0017 | 0.77 |
| MCP1.1 | CCL2 | <0.0001 | 0.66 |
| CAT.1 | CAT | <0.0001 | 0.53 |
| CASP10.1 | CASP10 | 0.0001 | 0.72 |
| CALD1.2 | CALD1 | <0.0001 | 0.55 |
| CACNA2D1.1 | CACNA2D1 | 0.0352 | 0.84 |
| CA9.3 | CA9 | 0.0299 | 0.84 |
| CA2.1 | CA2 | <0.0001 | 0.58 |
| C3AR1.1 | C3AR1 | 0.0010 | 0.77 |
| ECRG4.1 | C2orf40 | <0.0001 | 0.47 |
| C1QA.1 | C1QA | 0.0119 | 0.82 |
| C13orf15.1 | C13orf15 | <0.0001 | 0.37 |
| BUB3.1 | BUB3 | <0.0001 | 0.67 |
| BTRC.1 | BTRC | <0.0001 | 0.65 |
| CIAP1.2 | BIRC2 | <0.0001 | 0.64 |
| BIN1.3 | BIN1 | 0.0001 | 0.73 |
| BGN.1 | BGN | <0.0001 | 0.63 |
| Bclx.1 | BCL2L1 | <0.0001 | 0.58 |
| Bcl2.2 | BCL2 | <0.0001 | 0.37 |
| Bax.1 | BAX | 0.0035 | 0.78 |
| Bak.2 | BAK1 | 0.0215 | 0.83 |
| BAG1.2 | BAG1 | <0.0001 | 0.40 |
| ATP6V1B1.1 | ATP6V1B1 | <0.0001 | 0.54 |
| ATP1A1.1 | ATP1A1 | 0.0037 | 0.78 |
| ASS1.1 | ASS1 | <0.0001 | 0.60 |
| ARRB1.1 | ARRB1 | <0.0001 | 0.45 |
| ARHGDIB.1 | ARHGDIB | <0.0001 | 0.50 |
| AQP1.1 | AQP1 | <0.0001 | 0.40 |
| APOLD1.1 | APOLD1 | <0.0001 | 0.54 |
| APC.4 | APC | <0.0001 | 0.57 |
| ANXA4.1 | ANXA4 | 0.0003 | 0.74 |

TABLE 4b-continued

Proxy genes for which increased expression is associated with lower tumor stage (p-value ≤ .05)

| Gene | Official Symbol | Stage 3 vs. 1 p-value | OR |
|---|---|---|---|
| ANXA1.2 | ANXA1 | 0.0001 | 0.73 |
| ANTXR1.1 | ANTXR1 | 0.0051 | 0.80 |
| ANGPTL4.1 | ANGPTL4 | 0.0041 | 0.80 |
| ANGPTL3.3 | ANGPTL3 | 0.0258 | 0.82 |
| ANGPTL2.1 | ANGPTL2 | 0.0015 | 0.77 |
| ANGPT2.1 | ANGPT2 | <0.0001 | 0.72 |
| ANGPT1.1 | ANGPT1 | <0.0001 | 0.45 |
| ALDOB.1 | ALDOB | <0.0001 | 0.60 |
| ALDH6A1.1 | ALDH6A1 | <0.0001 | 0.55 |
| ALDH4.2 | ALDH4A1 | 0.0124 | 0.82 |
| AKT3.2 | AKT3 | <0.0001 | 0.43 |
| AKT2.3 | AKT2 | <0.0001 | 0.64 |
| AKT1.3 | AKT1 | <0.0001 | 0.58 |
| AIF1.1 | AIF1 | 0.0002 | 0.74 |
| AHR.1 | AHR | <0.0001 | 0.59 |
| AGTR1.1 | AGTR1 | <0.0001 | 0.36 |
| ADH1B.1 | ADH1B | 0.0015 | 0.77 |
| ADD1.1 | ADD1 | <0.0001 | 0.40 |
| ADAMTS5.1 | ADAMTS5 | 0.0006 | 0.73 |
| ADAM17.1 | ADAM17 | <0.0001 | 0.72 |
| ACE2.1 | ACE2 | <0.0001 | 0.61 |
| ACADSB.1 | ACADSB | <0.0001 | 0.54 |
| BCRP.1 | ABCG2 | <0.0001 | 0.41 |
| MRP4.2 | ABCC4 | <0.0001 | 0.65 |
| MRP3.1 | ABCC3 | 0.0005 | 0.76 |
| MRP1.1 | ABCC1 | 0.0017 | 0.78 |
| ABCB1.5 | ABCB1 | 0.0003 | 0.75 |
| NPD009 (ABAT official).3 | ABAT | <0.0001 | 0.70 |
| AAMP.1 | AAMP | 0.0292 | 0.84 |
| A2M.1 | A2M | <0.0001 | 0.36 |

TABLE 5a

Proxy genes for which increased expression is associated with higher tumor grade (p-value ≤ .05)

| Gene | Official Symbol | CCF Grade p-value | OR |
|---|---|---|---|
| WT1.1 | WT1 | <0.0001 | 1.39 |
| VTN.1 | VTN | 0.0359 | 1.16 |
| VDR.2 | VDR | 0.0001 | 1.29 |
| UBE2T.1 | UBE2T | <0.0001 | 1.81 |
| TP.3 | TYMP | <0.0001 | 1.35 |
| C20orf1.1 | TPX2 | <0.0001 | 2.14 |
| TOP2A.4 | TOP2A | <0.0001 | 2.07 |
| TNFSF13B.1 | TNFSF13B | 0.0062 | 1.20 |
| TK1.2 | TK1 | <0.0001 | 1.66 |
| TGFBI.1 | TGFBI | 0.0452 | 1.14 |
| STAT1.3 | STAT1 | <0.0001 | 1.31 |
| SQSTM1.1 | SQSTM1 | 0.0003 | 1.27 |
| OPN, osteopontin.3 | SPP1 | 0.0002 | 1.29 |
| SLC7A5.2 | SLC7A5 | 0.0002 | 1.28 |
| SLC16A3.1 | SLC16A3 | 0.0052 | 1.21 |
| SLC13A3.1 | SLC13A3 | 0.0003 | 1.27 |
| SFN.1 | SFN | 0.0066 | 1.20 |
| SEMA3C.1 | SEMA3C | <0.0001 | 1.32 |
| SAA2.2 | SAA2 | <0.0001 | 2.13 |
| S100A1.1 | S100A1 | <0.0001 | 1.40 |
| RRM2.1 | RRM2 | <0.0001 | 1.71 |
| RPLP1.1 | RPLP1 | 0.0007 | 1.25 |
| RAD51.1 | RAD51 | <0.0001 | 1.53 |
| PTTG1.2 | PTTG1 | <0.0001 | 1.89 |
| PSMB9.1 | PSMB9 | 0.0010 | 1.25 |
| PSMB8.1 | PSMB8 | 0.0181 | 1.17 |
| PRKCB1.1 | PRKCB | 0.0218 | 1.16 |
| PDCD1.1 | PDCD1 | <0.0001 | 1.43 |
| PCSK6.1 | PCSK6 | 0.0009 | 1.25 |
| PCNA.2 | PCNA | 0.0041 | 1.21 |
| NME2.1 | NME2 | 0.0106 | 1.19 |
| MYBL2.1 | MYBL2 | <0.0001 | 1.70 |
| MMP9.1 | MMP9 | <0.0001 | 1.46 |
| MMP14.1 | MMP14 | 0.0003 | 1.28 |
| Ki-67.2 | MKI67 | <0.0001 | 1.70 |
| mGST1.2 | MGST1 | <0.0001 | 2.13 |
| cMet.2 | MET | <0.0001 | 1.57 |
| MDK.1 | MDK | <0.0001 | 1.55 |
| MDH2.1 | MDH2 | <0.0001 | 1.35 |
| MCM2.2 | MCM2 | <0.0001 | 1.33 |
| LOX.1 | LOX | <0.0001 | 1.35 |
| LMNB1.1 | LMNB1 | <0.0001 | 1.76 |
| LIMK1.1 | LIMK1 | <0.0001 | 1.43 |
| LAPTM5.1 | LAPTM5 | 0.0044 | 1.21 |
| LAMB3.1 | LAMB3 | <0.0001 | 1.49 |
| L1CAM.1 | L1CAM | 0.0338 | 1.15 |
| KLRK1.2 | KLRK1 | 0.0412 | 1.15 |
| CD18.2 | ITGB2 | 0.0069 | 1.21 |
| IL-8.1 | IL8 | 0.0088 | 1.19 |
| IL6.3 | IL6 | 0.0091 | 1.19 |
| ICAM1.1 | ICAM1 | 0.0014 | 1.24 |
| HSPA8.1 | HSPA8 | <0.0001 | 1.39 |
| HPD.1 | HPD | 0.0054 | 1.20 |
| HIST1H1D.1 | HIST1H1D | 0.0248 | 1.16 |
| HGD.1 | HGD | <0.0001 | 1.41 |
| GZMA.1 | GZMA | 0.0006 | 1.26 |
| GPX2.2 | GPX2 | 0.0182 | 1.18 |
| GPX1.2 | GPX1 | 0.0008 | 1.25 |
| FCGR3A.1 | FCGR3A | 0.0003 | 1.27 |
| fasl.2 | FASLG | 0.0045 | 1.21 |
| FABP1.1 | FABP1 | <0.0001 | 1.32 |
| F2.1 | F2 | <0.0001 | 1.77 |
| ESPL1.3 | ESPL1 | <0.0001 | 1.60 |
| E2F1.3 | E2F1 | <0.0001 | 1.36 |
| CXCR6.1 | CXCR6 | <0.0001 | 1.50 |
| BLR1.1 | CXCR5 | 0.0338 | 1.15 |
| CXCL9.1 | CXCL9 | 0.0001 | 1.29 |
| CXCL10.1 | CXCL10 | 0.0078 | 1.19 |
| GRO1.2 | CXCL1 | <0.0001 | 1.39 |
| CTSD.2 | CTSD | 0.0183 | 1.17 |
| CTSB.1 | CTSB | 0.0006 | 1.26 |
| CRP.1 | CRP | 0.0342 | 1.15 |
| CP.1 | CP | <0.0001 | 1.37 |
| Chk2.3 | CHEK2 | <0.0001 | 1.37 |
| Chk1.2 | CHEK1 | <0.0001 | 1.37 |
| CENPF.1 | CENPF | <0.0001 | 1.78 |
| CD8A.1 | CD8A | <0.0001 | 1.35 |
| CD82.3 | CD82 | <0.0001 | 1.50 |
| TNFSF7.1 | CD70 | <0.0001 | 1.43 |
| CCNE1.1 | CCNE1 | 0.0002 | 1.29 |
| CCNB1.2 | CCNB1 | <0.0001 | 1.75 |
| CCL5.2 | CCL5 | <0.0001 | 1.63 |
| CCL20.1 | CCL20 | 0.0082 | 1.19 |
| CAV2.1 | CAV2 | 0.0210 | 1.17 |
| CA12.1 | CA12 | <0.0001 | 1.41 |
| C3.1 | C3 | <0.0001 | 1.34 |
| C1QB.1 | C1QB | 0.0201 | 1.17 |
| BUB1.1 | BUB1 | <0.0001 | 2.16 |
| BRCA1.2 | BRCA1 | 0.0004 | 1.26 |
| SURV.2 | BIRC5 | <0.0001 | 1.93 |
| cIAP2.2 | BIRC3 | <0.0001 | 1.44 |
| STK15.2 | AURKA | <0.0001 | 1.38 |
| ATP5E.1 | ATP5E | <0.0001 | 1.45 |
| APOL1.1 | APOL1 | <0.0001 | 1.47 |
| APOE.1 | APOE | <0.0001 | 1.40 |
| APOC1.3 | APOC1 | <0.0001 | 1.42 |
| ANXA2.2 | ANXA2 | 0.0020 | 1.23 |
| ANGPTL3.3 | ANGPTL3 | <0.0001 | 1.32 |
| AMACR1.1 | AMACR | 0.0382 | 1.15 |
| ALOX5.1 | ALOX5 | 0.0001 | 1.29 |
| ALDH4.2 | ALDH4A1 | 0.0002 | 1.28 |

TABLE 5a-continued

Proxy genes for which increased expression is associated with higher tumor grade (p-value ≤ .05)

| Gene | Official Symbol | CCF Grade p-value | CCF Grade OR |
|---|---|---|---|
| ADAM8.1 | ADAM8 | 0.0006 | 1.26 |
| MRP2.3 | ABCC2 | <0.0001 | 1.97 |

TABLE 5b

Proxy genes for which increased expression is associated with lower tumor grade (p-value ≤ .05)

| Gene | Official Symbol | CCF Grade p-value | CCF Grade OR |
|---|---|---|---|
| ZHX2.1 | ZHX2 | 0.0061 | 0.83 |
| YB-1.2 | YBX1 | <0.0001 | 0.62 |
| XPNPEP2.2 | XPNPEP2 | 0.0040 | 0.82 |
| XIAP.1 | XIAP | <0.0001 | 0.64 |
| WISP1.1 | WISP1 | <0.0001 | 0.58 |
| VWF.1 | VWF | <0.0001 | 0.34 |
| VHL.1 | VHL | 0.0088 | 0.84 |
| VEGF.1 | VEGFA | <0.0001 | 0.48 |
| VCAN.1 | VCAN | 0.0023 | 0.82 |
| VCAM1.1 | VCAM1 | 0.0049 | 0.83 |
| USP34.1 | USP34 | <0.0001 | 0.62 |
| UMOD.1 | UMOD | <0.0001 | 0.69 |
| UGCG.1 | UGCG | <0.0001 | 0.58 |
| UBB.1 | UBB | <0.0001 | 0.62 |
| UBE1C.1 | UBA3 | <0.0001 | 0.67 |
| tusc4.2 | TUSC4 | <0.0001 | 0.61 |
| TUSC2.1 | TUSC2 | 0.0481 | 0.88 |
| TSPAN7.2 | TSPAN7 | <0.0001 | 0.29 |
| TSC2.1 | TSC2 | <0.0001 | 0.60 |
| TSC1.1 | TSC1 | <0.0001 | 0.52 |
| P53.2 | TP53 | <0.0001 | 0.66 |
| TOP2B.2 | TOP2B | <0.0001 | 0.68 |
| TNIP2.1 | TNIP2 | 0.0001 | 0.76 |
| TNFSF12.1 | TNFSF12 | <0.0001 | 0.54 |
| TNFRSF11B.1 | TNFRSF11B | <0.0001 | 0.73 |
| TNFRSF10D.1 | TNFRSF10D | <0.0001 | 0.51 |
| TNFRSF10C.3 | TNFRSF10C | 0.0003 | 0.78 |
| DR5.2 | TNFRSF10B | <0.0001 | 0.69 |
| TNFAIP6.1 | TNFAIP6 | 0.0338 | 0.87 |
| TNFAIP3.1 | TNFAIP3 | 0.0083 | 0.84 |
| TNF.1 | TNF | 0.0392 | 0.87 |
| TMEM47.1 | TMEM47 | <0.0001 | 0.33 |
| TMEM27.1 | TMEM27 | <0.0001 | 0.73 |
| TIMP3.3 | TIMP3 | <0.0001 | 0.29 |
| TIMP2.1 | TIMP2 | <0.0001 | 0.54 |
| THBS1.1 | THBS1 | <0.0001 | 0.58 |
| THBD.1 | THBD | <0.0001 | 0.66 |
| TGFBR2.3 | TGFBR2 | <0.0001 | 0.32 |
| TGFBR1.1 | TGFBR1 | <0.0001 | 0.59 |
| TGFB2.2 | TGFB2 | <0.0001 | 0.54 |
| TGFb1.1 | TGFB1 | <0.0001 | 0.66 |
| TGFA.2 | TGFA | <0.0001 | 0.68 |
| TEK.1 | TEK | <0.0001 | 0.34 |
| cripto (TDGF1 official).1 | TDGF1 | 0.0328 | 0.86 |
| TCF4.1 | TCF4 | <0.0001 | 0.33 |
| TAGLN.1 | TAGLN | <0.0001 | 0.58 |
| TACSTD2.1 | TACSTD2 | <0.0001 | 0.61 |
| SUCLG1.1 | SUCLG1 | <0.0001 | 0.76 |
| STK11.1 | STK11 | <0.0001 | 0.53 |
| STC2.1 | STC2 | 0.0085 | 0.84 |
| STAT5B.2 | STAT5B | <0.0001 | 0.40 |
| STAT5A.1 | STAT5A | <0.0001 | 0.60 |
| STAT3.1 | STAT3 | <0.0001 | 0.48 |
| SPRY1.1 | SPRY1 | <0.0001 | 0.40 |
| SPAST.1 | SPAST | 0.0002 | 0.78 |
| SPARCL1.1 | SPARCL1 | <0.0001 | 0.41 |
| SPARC.1 | SPARC | <0.0001 | 0.50 |
| SNRK.1 | SNRK | <0.0001 | 0.29 |
| SNAI1.1 | SNAI1 | <0.0001 | 0.54 |
| MADH4.1 | SMAD4 | <0.0001 | 0.39 |
| MADH2.1 | SMAD2 | <0.0001 | 0.40 |
| SLC9A1.1 | SLC9A1 | <0.0001 | 0.75 |
| SLC34A1.1 | SLC34A1 | 0.0001 | 0.76 |
| SKIL.1 | SKIL | <0.0001 | 0.52 |
| SHC1.1 | SHC1 | 0.0063 | 0.83 |
| SHANK3.1 | SHANK3 | <0.0001 | 0.27 |
| SGK.1 | SGK1 | <0.0001 | 0.60 |
| FRP1.3 | SFRP1 | 0.0003 | 0.78 |
| PAI1.3 | SERPINE1 | 0.0115 | 0.85 |
| SEMA3F.3 | SEMA3F | <0.0001 | 0.45 |
| SELENBP1.1 | SELENBP1 | <0.0001 | 0.63 |
| SELE.1 | SELE | <0.0001 | 0.74 |
| SDPR.1 | SDPR | <0.0001 | 0.35 |
| SDHA.1 | SDHA | <0.0001 | 0.69 |
| SCNN1A.2 | SCNN1A | 0.0011 | 0.80 |
| SCN4B.1 | SCN4B | <0.0001 | 0.47 |
| S100A2.1 | S100A2 | <0.0001 | 0.72 |
| RUNX1.1 | RUNX1 | 0.0001 | 0.77 |
| RRM1.2 | RRM1 | 0.0438 | 0.87 |
| KIAA1303 raptor.1 | RPTOR | <0.0001 | 0.53 |
| RPS6KB1.3 | RPS6KB1 | <0.0001 | 0.49 |
| RPS23.1 | RPS23 | <0.0001 | 0.59 |
| ROCK2.1 | ROCK2 | <0.0001 | 0.42 |
| ROCK1.1 | ROCK1 | <0.0001 | 0.31 |
| RIPK1.1 | RIPK1 | <0.0001 | 0.50 |
| rhoC.1 | RHOC | <0.0001 | 0.70 |
| RhoB.1 | RHOB | <0.0001 | 0.36 |
| ARHA.1 | RHOA | <0.0001 | 0.34 |
| RHEB.2 | RHEB | <0.0001 | 0.72 |
| RGS5.1 | RGS5 | <0.0001 | 0.30 |
| FLJ22655.1 | RERGL | <0.0001 | 0.42 |
| NFKBp65.3 | RELA | <0.0001 | 0.69 |
| RB1.1 | RB1 | <0.0001 | 0.74 |
| RASSF1.1 | RASSF1 | <0.0001 | 0.60 |
| RARB.2 | RARB | <0.0001 | 0.41 |
| RALBP1.1 | RALBP1 | <0.0001 | 0.47 |
| RAF1.3 | RAF1 | <0.0001 | 0.48 |
| RAC1.3 | RAC1 | <0.0001 | 0.75 |
| PXDN.1 | PXDN | <0.0001 | 0.74 |
| PTPRG.1 | PTPRG | <0.0001 | 0.29 |
| PTPRB.1 | PTPRB | <0.0001 | 0.27 |
| PTN.1 | PTN | <0.0001 | 0.58 |
| PTK2.1 | PTK2 | <0.0001 | 0.36 |
| PTHR1.1 | PTH1R | <0.0001 | 0.50 |
| PTEN.2 | PTEN | <0.0001 | 0.40 |
| PSMA7.1 | PSMA7 | 0.0002 | 0.78 |
| PRPS2.1 | PRPS2 | 0.0012 | 0.80 |
| PROM2.1 | PROM2 | 0.0326 | 0.87 |
| PRKCH.1 | PRKCH | <0.0001 | 0.45 |
| PRKCD.2 | PRKCD | <0.0001 | 0.76 |
| PPP2CA.1 | PPP2CA | <0.0001 | 0.68 |
| PPARG.3 | PPARG | <0.0001 | 0.42 |
| PPAP2B.1 | PPAP2B | <0.0001 | 0.32 |
| PMP22.1 | PMP22 | <0.0001 | 0.61 |
| PLG.1 | PLG | <0.0001 | 0.75 |
| PLAT.1 | PLAT | <0.0001 | 0.42 |
| PLA2G4C.1 | PLA2G4C | 0.0002 | 0.78 |
| PIK3CA.1 | PIK3CA | <0.0001 | 0.48 |
| PI3K.2 | PIK3C2B | <0.0001 | 0.53 |
| PGF.1 | PGF | <0.0001 | 0.74 |
| PFKP.1 | PFKP | 0.0008 | 0.80 |
| CD31.3 | PECAM1 | <0.0001 | 0.32 |
| PDZK3.1 | PDZK3 | <0.0001 | 0.72 |
| PDZK1.1 | PDZK1 | <0.0001 | 0.76 |
| PDGFRb.3 | PDGFRB | <0.0001 | 0.42 |
| PDGFRa.2 | PDGFRA | 0.0022 | 0.82 |
| PDGFD.2 | PDGFD | <0.0001 | 0.39 |
| PDGFC.3 | PDGFC | <0.0001 | 0.57 |
| PDGFB.3 | PDGFB | <0.0001 | 0.33 |

TABLE 5b-continued

Proxy genes for which increased expression is associated with lower tumor grade (p-value ≤ .05)

| Gene | Official Symbol | CCF Grade p-value | OR |
|---|---|---|---|
| PDGFA.3 | PDGFA | <0.0001 | 0.42 |
| PCK1.1 | PCK1 | <0.0001 | 0.71 |
| PCCA.1 | PCCA | <0.0001 | 0.75 |
| PARD6A.1 | PARD6A | 0.0088 | 0.84 |
| Pak1.2 | PAK1 | 0.0014 | 0.81 |
| PAH.1 | PAH | 0.0160 | 0.85 |
| OGG1.1 | OGG1 | 0.0139 | 0.85 |
| BFGF.3 | NUDT6 | <0.0001 | 0.63 |
| NPR1.1 | NPR1 | <0.0001 | 0.42 |
| NPM1.2 | NPM1 | <0.0001 | 0.61 |
| NOTCH3.1 | NOTCH3 | <0.0001 | 0.40 |
| NOTCH2.1 | NOTCH2 | <0.0001 | 0.58 |
| NOTCH1.1 | NOTCH1 | <0.0001 | 0.38 |
| NOS3.1 | NOS3 | <0.0001 | 0.42 |
| NOS2A.3 | NOS2 | <0.0001 | 0.56 |
| NOL3.1 | NOL3 | <0.0001 | 0.61 |
| NFX1.1 | NFX1 | <0.0001 | 0.53 |
| NFKBp50.3 | NFKB1 | <0.0001 | 0.59 |
| NFATC2.1 | NFATC2 | <0.0001 | 0.73 |
| NFAT5.1 | NFAT5 | <0.0001 | 0.58 |
| MYRIP.2 | MYRIP | <0.0001 | 0.63 |
| MYH11.1 | MYH11 | <0.0001 | 0.48 |
| cMYC.3 | MYC | <0.0001 | 0.68 |
| MX1.1 | MX1 | 0.0087 | 0.84 |
| MVP.1 | MVP | 0.0291 | 0.87 |
| MUC1.2 | MUC1 | 0.0043 | 0.83 |
| FRAP1.1 | MTOR | <0.0001 | 0.61 |
| MT1X.1 | MT1X | 0.0276 | 0.86 |
| MSH3.2 | MSH3 | 0.0001 | 0.76 |
| MSH2.3 | MSH2 | <0.0001 | 0.60 |
| MMP2.2 | MMP2 | <0.0001 | 0.74 |
| STMY3.3 | MMP11 | <0.0001 | 0.70 |
| MIF.2 | MIF | 0.0004 | 0.79 |
| MICA.1 | MICA | <0.0001 | 0.60 |
| MGMT.1 | MGMT | <0.0001 | 0.57 |
| MCM3.3 | MCM3 | <0.0001 | 0.73 |
| MCAM.1 | MCAM | <0.0001 | 0.42 |
| MARCKS.1 | MARCKS | <0.0001 | 0.63 |
| ERK1.3 | MAPK3 | <0.0001 | 0.35 |
| ERK2.3 | MAPK1 | <0.0001 | 0.71 |
| MAP4.1 | MAP4 | <0.0001 | 0.58 |
| MAP2K3.1 | MAP2K3 | <0.0001 | 0.60 |
| MAP2K1.1 | MAP2K1 | <0.0001 | 0.62 |
| MAL.1 | MAL | <0.0001 | 0.63 |
| LRP2.1 | LRP2 | 0.0275 | 0.86 |
| LMO2.1 | LMO2 | <0.0001 | 0.68 |
| LDB2.1 | LDB2 | <0.0001 | 0.28 |
| LDB1.2 | LDB1 | <0.0001 | 0.52 |
| LAMB1.1 | LAMB1 | <0.0001 | 0.73 |
| LAMA4.1 | LAMA4 | <0.0001 | 0.55 |
| KRT7.1 | KRT7 | <0.0001 | 0.61 |
| K-ras.10 | KRAS | <0.0001 | 0.54 |
| KL.1 | KL | <0.0001 | 0.62 |
| Kitlng.4 | KITLG | <0.0001 | 0.46 |
| c-kit.2 | KIT | <0.0001 | 0.48 |
| KDR.6 | KDR | <0.0001 | 0.33 |
| KCNJ15.1 | KCNJ15 | <0.0001 | 0.67 |
| HTATIP.1 | KAT5 | <0.0001 | 0.33 |
| G-Catenin.1 | JUP | <0.0001 | 0.39 |
| AP-1 (JUN official).2 | JUN | <0.0001 | 0.54 |
| JAG1.1 | JAG1 | <0.0001 | 0.28 |
| ITGB5.1 | ITGB5 | <0.0001 | 0.60 |
| ITGB3.1 | ITGB3 | <0.0001 | 0.68 |
| ITGB1.1 | ITGB1 | <0.0001 | 0.46 |
| ITGA7.1 | ITGA7 | <0.0001 | 0.40 |
| ITGA6.2 | ITGA6 | <0.0001 | 0.51 |
| ITGA5.1 | ITGA5 | <0.0001 | 0.62 |
| ITGA4.2 | ITGA4 | <0.0001 | 0.75 |
| ITGA3.2 | ITGA3 | 0.0128 | 0.85 |
| IQGAP2.1 | IQGAP2 | <0.0001 | 0.68 |
| INSR.1 | INSR | <0.0001 | 0.46 |
| INHBA.1 | INHBA | 0.0049 | 0.83 |
| IMP3.1 | IMP3 | <0.0001 | 0.67 |
| IL6ST.3 | IL6ST | <0.0001 | 0.43 |
| IL1B.1 | IL1B | 0.0102 | 0.84 |
| IL15.1 | IL15 | 0.0001 | 0.76 |
| IL10.3 | IL10 | 0.0239 | 0.86 |
| IGFBP6.1 | IGFBP6 | <0.0001 | 0.75 |
| IGFBP5.1 | IGFBP5 | <0.0001 | 0.74 |
| IGFBP2.1 | IGFBP2 | <0.0001 | 0.76 |
| IGF2.2 | IGF2 | <0.0001 | 0.69 |
| IGF1R.3 | IGF1R | <0.0001 | 0.43 |
| ID3.1 | ID3 | <0.0001 | 0.48 |
| ID2.4 | ID2 | <0.0001 | 0.64 |
| ID1.1 | ID1 | <0.0001 | 0.37 |
| ICAM2.1 | ICAM2 | <0.0001 | 0.42 |
| HYAL2.1 | HYAL2 | <0.0001 | 0.32 |
| HYAL1.1 | HYAL1 | <0.0001 | 0.52 |
| HSPG2.1 | HSPG2 | <0.0001 | 0.33 |
| HSPA1A.1 | HSPA1A | 0.0022 | 0.81 |
| HSP90AB1.1 | HSP90AB1 | <0.0001 | 0.68 |
| HSD11B2.1 | HSD11B2 | <0.0001 | 0.43 |
| HPCAL1.1 | HPCAL1 | <0.0001 | 0.69 |
| HNRPAB.3 | HNRNPAB | 0.0432 | 0.87 |
| HMGB1.1 | HMGB1 | <0.0001 | 0.47 |
| HIF1AN.1 | HIF1AN | <0.0001 | 0.64 |
| HIF1A.3 | HIF1A | <0.0001 | 0.55 |
| HGF.4 | HGF | 0.0022 | 0.81 |
| HDAC1.1 | HDAC1 | <0.0001 | 0.48 |
| HADH.1 | HADH | <0.0001 | 0.63 |
| GSTp.3 | GSTP1 | <0.0001 | 0.66 |
| GSTM3.2 | GSTM3 | <0.0001 | 0.53 |
| GSTM1.1 | GSTM1 | <0.0001 | 0.61 |
| GRB7.2 | GRB7 | <0.0001 | 0.73 |
| GRB14.1 | GRB14 | 0.0001 | 0.76 |
| GPC3.1 | GPC3 | 0.0012 | 0.80 |
| GNAS.1 | GNAS | <0.0001 | 0.70 |
| GMNN.1 | GMNN | 0.0006 | 0.80 |
| GJA1.1 | GJA1 | <0.0001 | 0.66 |
| GCLM.2 | GCLM | 0.0319 | 0.87 |
| GCLC.3 | GCLC | <0.0001 | 0.57 |
| GATM.1 | GATM | 0.0006 | 0.79 |
| GATA3.3 | GATA3 | 0.0029 | 0.82 |
| GAS2.1 | GAS2 | 0.0136 | 0.84 |
| GADD45B.1 | GADD45B | <0.0001 | 0.54 |
| FST.1 | FST | 0.0197 | 0.85 |
| FOS.1 | FOS | <0.0001 | 0.44 |
| FOLR1.1 | FOLR1 | <0.0001 | 0.75 |
| FLT4.1 | FLT4 | <0.0001 | 0.34 |
| FLT3LG.1 | FLT3LG | <0.0001 | 0.73 |
| FLT1.1 | FLT1 | <0.0001 | 0.29 |
| FILIP1.1 | FILIP1 | <0.0001 | 0.47 |
| FIGF.1 | FIGF | <0.0001 | 0.70 |
| FHL1.1 | FHL1 | <0.0001 | 0.54 |
| FHIT.1 | FHIT | <0.0001 | 0.72 |
| FH.1 | FH | 0.0203 | 0.86 |
| FGFR2 isoform 1.1 | FGFR2 | <0.0001 | 0.62 |
| FGFR1.3 | FGFR1 | <0.0001 | 0.48 |
| FGF2.2 | FGF2 | <0.0001 | 0.62 |
| FGF1.1 | FGF1 | <0.0001 | 0.61 |
| FDPS.1 | FDPS | <0.0001 | 0.52 |
| FBXW7.1 | FBXW7 | <0.0001 | 0.57 |
| FAP.1 | FAP | 0.0440 | 0.87 |
| ESRRG.3 | ESRRG | 0.0340 | 0.87 |
| ERG.1 | ERG | <0.0001 | 0.36 |
| ERCC4.1 | ERCC4 | 0.0337 | 0.87 |
| ERCC1.2 | ERCC1 | <0.0001 | 0.59 |
| ERBB4.3 | ERBB4 | <0.0001 | 0.66 |
| HER2.5 | ERBB2 | <0.0001 | 0.57 |
| EPHB4.1 | EPHB4 | <0.0001 | 0.43 |
| EPHA2.1 | EPHA2 | <0.0001 | 0.44 |
| EPAS1.1 | EPAS1 | <0.0001 | 0.26 |
| ENPP2.1 | ENPP2 | <0.0001 | 0.62 |
| ENPEP.1 | ENPEP | <0.0001 | 0.75 |

TABLE 5b-continued

Proxy genes for which increased expression is associated with lower tumor grade (p-value ≤ .05)

| Gene | Official Symbol | CCF Grade p-value | OR |
|---|---|---|---|
| ENO2.1 | ENO2 | 0.0449 | 0.88 |
| CD105.1 | ENG | <0.0001 | 0.30 |
| EMP1.1 | EMP1 | <0.0001 | 0.42 |
| EMCN.1 | EMCN | <0.0001 | 0.31 |
| ELTD1.1 | ELTD1 | <0.0001 | 0.59 |
| EIF2C1.1 | EIF2C1 | <0.0001 | 0.63 |
| EGR1.1 | EGR1 | <0.0001 | 0.50 |
| EGLN3.1 | EGLN3 | <0.0001 | 0.69 |
| EGF.3 | EGF | 0.0200 | 0.85 |
| EFNB2.1 | EFNB2 | <0.0001 | 0.36 |
| EFNB1.2 | EFNB1 | <0.0001 | 0.46 |
| EEF1A1.1 | EEF1A1 | <0.0001 | 0.39 |
| EDNRB.1 | EDNRB | <0.0001 | 0.33 |
| EDN2.1 | EDN2 | <0.0001 | 0.67 |
| EDN1 endothelin.1 | EDN1 | <0.0001 | 0.41 |
| EBAG9.1 | EBAG9 | 0.0057 | 0.83 |
| DUSP1.1 | DUSP1 | <0.0001 | 0.54 |
| DPEP1.1 | DPEP1 | 0.0001 | 0.76 |
| DLL4.1 | DLL4 | <0.0001 | 0.49 |
| DLC1.1 | DLC1 | <0.0001 | 0.33 |
| DKFZP564O0823.1 | DKFZP564O0823 | <0.0001 | 0.46 |
| DICER1.2 | DICER1 | <0.0001 | 0.41 |
| DIAPH1.1 | DIAPH1 | 0.0022 | 0.81 |
| DIABLO.1 | DIABLO | <0.0001 | 0.73 |
| DHPS.3 | DHPS | <0.0001 | 0.41 |
| DET1.1 | DET1 | <0.0001 | 0.63 |
| DEFB1.1 | DEFB1 | 0.0001 | 0.77 |
| DAPK1.3 | DAPK1 | <0.0001 | 0.48 |
| DAG1.1 | DAG1 | 0.0150 | 0.85 |
| CYR61.1 | CYR61 | <0.0001 | 0.49 |
| CXCL12.1 | CXCL12 | <0.0001 | 0.64 |
| CX3CR1.1 | CX3CR1 | 0.0008 | 0.80 |
| CX3CL1.1 | CX3CL1 | <0.0001 | 0.55 |
| CUL1.1 | CUL1 | <0.0001 | 0.62 |
| CUBN.1 | CUBN | 0.0081 | 0.84 |
| CTSL.2 | CTSL1 | 0.0328 | 0.87 |
| B-Catenin.3 | CTNNB1 | <0.0001 | 0.36 |
| A-Catenin.2 | CTNNA1 | <0.0001 | 0.73 |
| CTGF.1 | CTGF | <0.0001 | 0.61 |
| CSF1.1 | CSF1 | <0.0001 | 0.66 |
| CRADD.1 | CRADD | 0.0151 | 0.85 |
| COL5A2.2 | COL5A2 | 0.0155 | 0.85 |
| COL4A2.1 | COL4A2 | <0.0001 | 0.51 |
| COL4A1.1 | COL4A1 | <0.0001 | 0.59 |
| COL1A2.1 | COL1A2 | 0.0005 | 0.79 |
| COL18A1.1 | COL18A1 | <0.0001 | 0.53 |
| CLDN10.1 | CLDN10 | 0.0351 | 0.87 |
| CLCNKB.1 | CLCNKB | <0.0001 | 0.73 |
| CFLAR.1 | CFLAR | <0.0001 | 0.45 |
| CEACAM1.1 | CEACAM1 | <0.0001 | 0.64 |
| p27.3 | CDKN1B | <0.0001 | 0.65 |
| p21.3 | CDKN1A | <0.0001 | 0.52 |
| CDK4.1 | CDK4 | 0.0200 | 0.86 |
| CDH5.1 | CDH5 | <0.0001 | 0.31 |
| CDH16.1 | CDH16 | 0.0005 | 0.79 |
| CDH13.1 | CDH13 | <0.0001 | 0.40 |
| CD99.1 | CD99 | 0.0001 | 0.77 |
| CD44.1 | CD44_1 | 0.0216 | 0.86 |
| CD36.1 | CD36 | <0.0001 | 0.42 |
| CD34.1 | CD34 | <0.0001 | 0.39 |
| CD14.1 | CD14 | 0.0021 | 0.81 |
| CCND1.3 | CCND1 | <0.0001 | 0.63 |
| MCP1.1 | CCL2 | <0.0001 | 0.69 |
| CAT.1 | CAT | 0.0014 | 0.81 |
| CASP10.1 | CASP10 | <0.0001 | 0.65 |
| CALD1.2 | CALD1 | <0.0001 | 0.44 |
| CACNA2D1.1 | CACNA2D1 | 0.0003 | 0.78 |
| CA9.3 | CA9 | 0.0269 | 0.86 |
| CA2.1 | CA2 | 0.0001 | 0.77 |
| C7.1 | C7 | <0.0001 | 0.71 |
| C3AR1.1 | C3AR1 | 0.0032 | 0.82 |
| ECRG4.1 | C2orf40 | <0.0001 | 0.50 |
| C13orf15.1 | C13orf15 | <0.0001 | 0.37 |
| BUB3.1 | BUB3 | <0.0001 | 0.65 |
| BTRC.1 | BTRC | <0.0001 | 0.61 |
| BNIP3.1 | BNIP3 | 0.0018 | 0.81 |
| CIAP1.2 | BIRC2 | <0.0001 | 0.61 |
| BGN.1 | BGN | <0.0001 | 0.43 |
| Bclx.2 | BCL2L1 | <0.0001 | 0.76 |
| Bcl2.2 | BCL2 | <0.0001 | 0.45 |
| BAG1.2 | BAG1 | <0.0001 | 0.47 |
| AXL.1 | AXL | <0.0001 | 0.74 |
| ATP6V1B1.1 | ATP6V1B1 | <0.0001 | 0.65 |
| ASS1.1 | ASS1 | <0.0001 | 0.67 |
| ARRB1.1 | ARRB1 | <0.0001 | 0.49 |
| ARHGDIB.1 | ARHGDIB | <0.0001 | 0.50 |
| ARF1.1 | ARF1 | <0.0001 | 0.69 |
| AREG.2 | AREG | 0.0007 | 0.80 |
| AQP1.1 | AQP1 | <0.0001 | 0.49 |
| APOLD1.1 | APOLD1 | <0.0001 | 0.40 |
| APC.4 | APC | <0.0001 | 0.62 |
| APAF.2 | APAF1 | <0.0001 | 0.76 |
| ANXA1.2 | ANXA1 | <0.0001 | 0.65 |
| ANTXR1.1 | ANTXR1 | <0.0001 | 0.61 |
| ANGPTL4.1 | ANGPTL4 | <0.0001 | 0.75 |
| ANGPTL2.1 | ANGPTL2 | <0.0001 | 0.60 |
| ANGPT2.1 | ANGPT2 | <0.0001 | 0.61 |
| ANGPT1.1 | ANGPT1 | <0.0001 | 0.33 |
| ALDOB.1 | ALDOB | 0.0348 | 0.87 |
| ALDH6A1.1 | ALDH6A1 | <0.0001 | 0.61 |
| AKT3.2 | AKT3 | <0.0001 | 0.30 |
| AKT2.3 | AKT2 | <0.0001 | 0.65 |
| AKT1.3 | AKT1 | <0.0001 | 0.50 |
| AHR.1 | AHR | <0.0001 | 0.55 |
| AGTR1.1 | AGTR1 | <0.0001 | 0.44 |
| ADH1B.1 | ADH1B | <0.0001 | 0.70 |
| ADD1.1 | ADD1 | <0.0001 | 0.40 |
| ADAMTS9.1 | ADAMTS9 | <0.0001 | 0.64 |
| ADAMTS5.1 | ADAMTS5 | <0.0001 | 0.56 |
| ADAMTS4.1 | ADAMTS4 | <0.0001 | 0.66 |
| ADAMTS2.1 | ADAMTS2 | <0.0001 | 0.69 |
| ADAMTS1.1 | ADAMTS1 | <0.0001 | 0.51 |
| ADAM17.1 | ADAM17 | <0.0001 | 0.67 |
| ACADSB.1 | ACADSB | <0.0001 | 0.63 |
| BCRP.1 | ABCG2 | <0.0001 | 0.43 |
| MRP4.2 | ABCC4 | 0.0337 | 0.87 |
| AAMP.1 | AAMP | <0.0001 | 0.71 |
| A2M.1 | A2M | <0.0001 | 0.29 |

TABLE 6a

Proxy genes for which increased expression is associated with the presence of necrosis (p-value ≤ .05)

| Gene | Official Symbol | CCF Necrosis p-value | OR |
|---|---|---|---|
| WT1.1 | WT1 | <0.0001 | 1.57 |
| VTN.1 | VTN | <0.0001 | 1.38 |
| VDR.2 | VDR | 0.0013 | 1.34 |
| UBE2T.1 | UBE2T | <0.0001 | 2.08 |
| TP.3 | TYMP | 0.0008 | 1.37 |
| TSPAN8.1 | TSPAN8 | 0.0016 | 1.29 |
| C20orf1.1 | TPX2 | <0.0001 | 2.64 |
| TOP2A.4 | TOP2A | <0.0001 | 2.02 |
| TNFSF13B.1 | TNFSF13B | 0.0002 | 1.38 |
| TK1.2 | TK1 | <0.0001 | 1.71 |
| TIMP1.1 | TIMP1 | 0.0076 | 1.27 |
| TGFBI.1 | TGFBI | <0.0001 | 1.69 |
| OPN, osteopontin.3 | SPP1 | <0.0001 | 1.81 |

TABLE 6a-continued

Proxy genes for which increased expression is associated with the presence of necrosis (p-value ≤ .05)

| Gene | Official Symbol | CCF Necrosis p-value | OR |
|---|---|---|---|
| SPHK1.1 | SPHK1 | <0.0001 | 1.44 |
| SLC7A5.2 | SLC7A5 | <0.0001 | 2.12 |
| SLC2A1.1 | SLC2A1 | <0.0001 | 1.46 |
| SLC16A3.1 | SLC16A3 | 0.0001 | 1.48 |
| SLC13A3.1 | SLC13A3 | 0.0019 | 1.29 |
| SHC1.1 | SHC1 | 0.0156 | 1.24 |
| SFN.1 | SFN | <0.0001 | 1.57 |
| PAI.3 | SERPINE1 | 0.0164 | 1.25 |
| SERPINA5.1 | SERPINA5 | 0.0016 | 1.27 |
| SEMA3C.1 | SEMA3C | <0.0001 | 2.14 |
| SELL.1 | SELL | 0.0096 | 1.26 |
| SAA2.2 | SAA2 | <0.0001 | 2.50 |
| RRM2.1 | RRM2 | <0.0001 | 1.86 |
| RPLP1.1 | RPLP1 | 0.0025 | 1.32 |
| RND3.1 | RND3 | 0.0002 | 1.41 |
| RAD51.1 | RAD51 | <0.0001 | 1.51 |
| PTTG1.2 | PTTG1 | <0.0001 | 2.52 |
| COX2.1 | PTGS2 | 0.0002 | 1.36 |
| PRKCB1.1 | PRKCB | 0.0188 | 1.23 |
| PRKCA.1 | PRKCA | 0.0339 | 1.21 |
| PLAUR.3 | PLAUR | <0.0001 | 1.60 |
| upa.3 | PLAU | 0.0002 | 1.41 |
| PF4.1 | PF4 | 0.0003 | 1.34 |
| PDCD1.1 | PDCD1 | <0.0001 | 1.40 |
| PCSK6.1 | PCSK6 | 0.0297 | 1.22 |
| PCNA.2 | PCNA | 0.0025 | 1.33 |
| NNMT.1 | NNMT | 0.0206 | 1.22 |
| NME2.1 | NME2 | 0.0124 | 1.25 |
| MYBL2.1 | MYBL2 | <0.0001 | 1.90 |
| MT1X.1 | MT1X | 0.0003 | 1.39 |
| MMP9.1 | MMP9 | <0.0001 | 1.96 |
| MMP7.1 | MMP7 | <0.0001 | 1.50 |
| MMP14.1 | MMP14 | <0.0001 | 1.50 |
| Ki-67.2 | MKI67 | <0.0001 | 1.96 |
| mGST1.2 | MGST1 | <0.0001 | 1.63 |
| cMet.2 | MET | 0.0357 | 1.22 |
| MDK.1 | MDK | <0.0001 | 1.78 |
| MCM2.2 | MCM2 | 0.0003 | 1.40 |
| LRRC2.1 | LRRC2 | 0.0114 | 1.22 |
| LOX.1 | LOX | <0.0001 | 1.99 |
| LMNB1.1 | LMNB1 | <0.0001 | 2.04 |
| LIMK1.1 | LIMK1 | <0.0001 | 2.51 |
| LGALS9.1 | LGALS9 | 0.0136 | 1.25 |
| LGALS1.1 | LGALS1 | <0.0001 | 1.46 |
| LAPTM5.1 | LAPTM5 | <0.0001 | 1.47 |
| LAMB3.1 | LAMB5 | <0.0001 | 1.96 |
| L1CAM.1 | L1CAM | <0.0001 | 1.43 |
| KRT19.3 | KRT19 | 0.0001 | 1.43 |
| ITGB4.2 | ITGB4 | 0.0492 | 1.19 |
| ISG20.1 | ISG20 | 0.0006 | 1.38 |
| IL-8.1 | IL8 | <0.0001 | 2.40 |
| IL6.3 | IL6 | <0.0001 | 2.02 |
| ICAM1.1 | ICAM1 | <0.0001 | 1.75 |
| HSPA8.1 | HSPA8 | 0.0004 | 1.38 |
| HIST1H1D.1 | HIST1H1D | 0.0017 | 1.33 |
| GPX1.2 | GPX1 | <0.0001 | 1.46 |
| FZD2.2 | FZD2 | 0.0031 | 1.27 |
| FN1.1 | FN1 | <0.0001 | 1.45 |
| FCGR3A.1 | FCGR3A | 0.0001 | 1.43 |
| FCER1G.2 | FCER1G | <0.0001 | 1.50 |
| FAP.1 | FAP | 0.0395 | 1.20 |
| F3.1 | F3 | <0.0001 | 1.62 |
| F2.1 | F2 | <0.0001 | 1.76 |
| ESPL1.3 | ESPL1 | 0.0008 | 1.33 |
| EPHB2.1 | EPHB2 | 0.0037 | 1.28 |
| EPHB1.3 | EPHB1 | 0.0041 | 1.25 |
| EPB41L3.1 | EPB41L3 | 0.0410 | 1.19 |
| ENO2.1 | ENO2 | 0.0001 | 1.46 |
| EIF4EBP1.1 | EIF4EBP1 | <0.0001 | 1.60 |
| E2F1.3 | E2F1 | <0.0001 | 1.65 |
| CXCR6.1 | CXCR6 | <0.0001 | 1.48 |
| CXCR4.3 | CXCR4 | 0.0118 | 1.26 |
| GRO1.2 | CXCL1 | <0.0001 | 1.83 |
| CTSB.1 | CTSB | <0.0001 | 1.70 |
| CRP.1 | CRP | 0.0494 | 1.16 |
| CP.1 | CP | <0.0001 | 1.98 |
| COL7A1.1 | COL7A1 | <0.0001 | 1.47 |
| COL1A1.1 | COL1A1 | 0.0059 | 1.28 |
| Chk2.3 | CHEK2 | 0.0010 | 1.33 |
| Chk1.2 | CHEK1 | <0.0001 | 1.49 |
| CENPF.1 | CENPF | <0.0001 | 2.08 |
| CD82.3 | CD82 | <0.0001 | 2.09 |
| CD68.2 | CD68 | 0.0163 | 1.24 |
| CD44s.1 | CD44_s | <0.0001 | 1.66 |
| CCNE2.2 | CCNE2_2 | <0.0001 | 1.50 |
| CCNE1.1 | CCNE1 | <0.0001 | 1.44 |
| CCNB1.2 | CCNB1 | <0.0001 | 2.28 |
| CCL5.2 | CCL5 | <0.0001 | 1.45 |
| CCL20.1 | CCL20 | 0.0121 | 1.24 |
| CAV2.1 | CAV2 | 0.0003 | 1.35 |
| CA12.1 | CA12 | <0.0001 | 2.11 |
| C3.1 | C3 | <0.0001 | 1.58 |
| C1QB.1 | C1QB | 0.0032 | 1.31 |
| BUB1.1 | BUB1 | <0.0001 | 2.25 |
| BRCA1.2 | BRCA1 | 0.0006 | 1.35 |
| SURV.2 | BIRC5 | <0.0001 | 2.11 |
| cIAP2.2 | BIRC3 | <0.0001 | 1.47 |
| BCL2A1.1 | BCL2A1 | 0.0004 | 1.34 |
| STK15.2 | AURKA | <0.0001 | 1.61 |
| PRO2000.3 | ATAD2 | 0.0166 | 1.24 |
| APOL1.1 | APOL1 | <0.0001 | 1.54 |
| APOC1.3 | APOC1 | 0.0026 | 1.30 |
| ANXA2.2 | ANXA2 | <0.0001 | 1.71 |
| ALOX5.1 | ALOX5 | 0.0004 | 1.38 |
| ADAM8.1 | ADAM8 | <0.0001 | 1.89 |
| MRP2.3 | ABCC2 | 0.0002 | 1.39 |

TABLE 6b

Proxy genes for which increased expression is associated with the absence of necrosis (p-value ≤ .05)

| Gene | Official Symbol | CCF Necrosis p-value | OR |
|---|---|---|---|
| YB-1.2 | YBX1 | 0.0010 | 0.74 |
| XIAP.1 | XIAP | <0.0001 | 0.68 |
| WWOX.5 | WWOX | <0.0001 | 0.63 |
| WISP1.1 | WISP1 | 0.0002 | 0.71 |
| VWF.1 | VWF | <0.0001 | 0.35 |
| VHL.1 | VHL | 0.0086 | 0.78 |
| VEGF.1 | VEGFA | <0.0001 | 0.50 |
| VCAM1.1 | VCAM1 | <0.0001 | 0.55 |
| USP34.1 | USP34 | <0.0001 | 0.64 |
| UMOD.1 | UMOD | <0.0001 | 0.36 |
| UGCG.1 | UGCG | <0.0001 | 0.54 |
| UBB.1 | UBB | <0.0001 | 0.48 |
| UBE1C.1 | UBA3 | <0.0001 | 0.59 |
| TS.1 | TYMS | <0.0001 | 0.70 |
| tusc4.2 | TUSC4 | <0.0001 | 0.68 |
| TUSC2.1 | TUSC2 | 0.0462 | 0.83 |
| TSPAN7.2 | TSPAN7 | <0.0001 | 0.25 |
| TSC2.1 | TSC2 | <0.0001 | 0.45 |
| TSC1.1 | TSC1 | <0.0001 | 0.45 |
| P53.2 | TP53 | <0.0001 | 0.61 |
| TOP2B.2 | TOP2B | <0.0001 | 0.69 |
| TNFSF12.1 | TNFSF12 | <0.0001 | 0.51 |
| TRAIL.1 | TNFSF10 | <0.0001 | 0.68 |
| TNFRSF11B.1 | TNFRSF11B | <0.0001 | 0.59 |
| TNFRSF10D.1 | TNFRSF10D | <0.0001 | 0.58 |
| DR5.2 | TNFRSF10B | 0.0001 | 0.71 |
| TNFAIP6.1 | TNFAIP6 | <0.0001 | 0.67 |

TABLE 6b-continued

Proxy genes for which increased expression is associated with the absence of necrosis (p-value ≤ .05)

| Gene | Official Symbol | CCF Necrosis p-value | OR |
|---|---|---|---|
| TMEM47.1 | TMEM47 | <0.0001 | 0.29 |
| TMEM27.1 | TMEM27 | <0.0001 | 0.40 |
| TLR3.1 | TLR3 | <0.0001 | 0.64 |
| TIMP3.3 | TIMP3 | <0.0001 | 0.23 |
| TIMP2.1 | TIMP2 | <0.0001 | 0.52 |
| THBS1.1 | THBS1 | <0.0001 | 0.62 |
| TGFBR2.3 | TGFBR2 | <0.0001 | 0.34 |
| TGFBR1.1 | TGFBR1 | <0.0001 | 0.63 |
| TGFB2.2 | TGFB2 | <0.0001 | 0.55 |
| TGFb1.1 | TGFB1 | 0.0036 | 0.76 |
| TGFA.2 | TGFA | <0.0001 | 0.56 |
| TEK.1 | TEK | <0.0001 | 0.23 |
| TCF4.1 | TCF4 | <0.0001 | 0.36 |
| TAGLN.1 | TAGLN | <0.0001 | 0.50 |
| TACSTD2.1 | TACSTD2 | <0.0001 | 0.64 |
| SUCLG1.1 | SUCLG1 | <0.0001 | 0.50 |
| STK11.1 | STK11 | <0.0001 | 0.48 |
| STAT5B.2 | STAT5B | <0.0001 | 0.36 |
| STAT5A.1 | STAT5A | <0.0001 | 0.56 |
| STAT3.1 | STAT3 | <0.0001 | 0.63 |
| SPRY1.1 | SPRY1 | <0.0001 | 0.42 |
| SPAST.1 | SPAST | 0.0004 | 0.74 |
| SPARCL1.1 | SPARCL1 | <0.0001 | 0.48 |
| SPARC.1 | SPARC | <0.0001 | 0.54 |
| SOD1.1 | SOD1 | <0.0001 | 0.67 |
| SNRK.1 | SNRK | <0.0001 | 0.25 |
| SNAI1.1 | SNAI1 | 0.0004 | 0.71 |
| MADH4.1 | SMAD4 | <0.0001 | 0.33 |
| MADH2.1 | SMAD2 | <0.0001 | 0.40 |
| SLC34A1.1 | SLC34A1 | <0.0001 | 0.47 |
| SLC22A6.1 | SLC22A6 | <0.0001 | 0.52 |
| SKIL.1 | SKIL | <0.0001 | 0.59 |
| SHANK3.1 | SHANK3 | <0.0001 | 0.25 |
| SGK.1 | SGK1 | <0.0001 | 0.54 |
| FRP1.3 | SFRP1 | 0.0053 | 0.77 |
| SEMA3F.3 | SEMA3F | <0.0001 | 0.43 |
| SELENBP1.1 | SELENBP1 | <0.0001 | 0.62 |
| SDPR.1 | SDPR | <0.0001 | 0.28 |
| SDHA.1 | SDHA | <0.0001 | 0.47 |
| SCNN1A.2 | SCNN1A | 0.0013 | 0.73 |
| SCN4B.1 | SCN4B | <0.0001 | 0.35 |
| S100A2.1 | S100A2 | 0.0355 | 0.82 |
| KIAA1303 raptor.1 | RPTOR | <0.0001 | 0.49 |
| RPS6KB1.3 | RPS6KB1 | <0.0001 | 0.55 |
| RPS6KA1.1 | RPS6KA1 | 0.0002 | 0.68 |
| RPS23.1 | RPS23 | <0.0001 | 0.47 |
| ROCK2.1 | ROCK2 | <0.0001 | 0.39 |
| ROCK1.1 | ROCK1 | <0.0001 | 0.35 |
| RIPK1.1 | RIPK1 | <0.0001 | 0.45 |
| rhoC.1 | RHOC | 0.0001 | 0.70 |
| RhoB.1 | RHOB | <0.0001 | 0.41 |
| ARHA.1 | RHOA | <0.0001 | 0.45 |
| RHEB.2 | RHEB | 0.0002 | 0.69 |
| RGS5.1 | RGS5 | <0.0001 | 0.26 |
| FLJ22655.1 | RERGL | <0.0001 | 0.26 |
| NFKBp65.3 | RELA | <0.0001 | 0.71 |
| RB1.1 | RB1 | <0.0001 | 0.54 |
| RASSF1.1 | RASSF1 | <0.0001 | 0.63 |
| RARB.2 | RARB | <0.0001 | 0.28 |
| RALBP1.1 | RALBP1 | <0.0001 | 0.52 |
| RAF1.3 | RAF1 | <0.0001 | 0.58 |
| RAC1.3 | RAC1 | 0.0118 | 0.80 |
| PTPRG.1 | PTPRG | <0.0001 | 0.27 |
| PTPRB.1 | PTPRB | <0.0001 | 0.22 |
| PTN.1 | PTN | <0.0001 | 0.41 |
| PTK2.1 | PTK2 | <0.0001 | 0.33 |
| PTHR1.1 | PTH1R | <0.0001 | 0.32 |
| PTEN.2 | PTEN | <0.0001 | 0.44 |
| PSMA7.1 | PSMA7 | 0.0173 | 0.81 |
| PRSS8.1 | PRSS8 | <0.0001 | 0.62 |
| PRKCH.1 | PRKCH | <0.0001 | 0.43 |
| PRKCD.2 | PRKCD | <0.0001 | 0.68 |
| PPP2CA.1 | PPP2CA | <0.0001 | 0.53 |
| PPARG.3 | PPARG | <0.0001 | 0.37 |
| PPAP2B.1 | PPAP2B | <0.0001 | 0.27 |
| PMP22.1 | PMP22 | 0.0155 | 0.81 |
| PLG.1 | PLG | <0.0001 | 0.38 |
| PLAT.1 | PLAT | <0.0001 | 0.42 |
| PLA2G4C.1 | PLA2G4C | <0.0001 | 0.48 |
| PIK3CA.1 | PIK3CA | <0.0001 | 0.47 |
| PI3K.2 | PIK3C2B | <0.0001 | 0.42 |
| PGF.1 | PGF | 0.0153 | 0.80 |
| PFKP.1 | PFKP | <0.0001 | 0.70 |
| CD31.3 | PECAM1 | <0.0001 | 0.34 |
| PDZK3.1 | PDZK3 | <0.0001 | 0.49 |
| PDZK1.1 | PDZK1 | <0.0001 | 0.45 |
| PDGFRb.3 | PDGFRB | <0.0001 | 0.45 |
| PDGFD.2 | PDGFD | <0.0001 | 0.33 |
| PDGFC.3 | PDGFC | <0.0001 | 0.53 |
| PDGFB.3 | PDGFB | <0.0001 | 0.33 |
| PDGFA.3 | PDGFA | <0.0001 | 0.43 |
| PCK1.1 | PCK1 | <0.0001 | 0.44 |
| PCCA.1 | PCCA | <0.0001 | 0.47 |
| PARD6A.1 | PARD6A | 0.0045 | 0.77 |
| Pak1.2 | PAK1 | 0.0003 | 0.74 |
| PAH.1 | PAH | <0.0001 | 0.62 |
| OGG1.1 | OGG1 | <0.0001 | 0.62 |
| BFGF.3 | NUDT6 | <0.0001 | 0.45 |
| NRG1.3 | NRG1 | 0.0004 | 0.69 |
| NPR1.1 | NPR1 | <0.0001 | 0.36 |
| NPM1.2 | NPM1 | <0.0001 | 0.55 |
| NOTCH3.1 | NOTCH3 | <0.0001 | 0.40 |
| NOTCH2.1 | NOTCH2 | <0.0001 | 0.68 |
| NOTCH1.1 | NOTCH1 | <0.0001 | 0.38 |
| NOS3.1 | NOS3 | <0.0001 | 0.37 |
| NOS2A.3 | NOS2 | <0.0001 | 0.42 |
| NOL3.1 | NOL3 | <0.0001 | 0.67 |
| NFX1.1 | NFX1 | <0.0001 | 0.43 |
| NFKBp50.3 | NFKB1 | <0.0001 | 0.56 |
| NFATC2.1 | NFATC2 | <0.0001 | 0.67 |
| NFAT5.1 | NFAT5 | <0.0001 | 0.55 |
| MYRIP.2 | MYRIP | <0.0001 | 0.36 |
| MYH11.1 | MYH11 | <0.0001 | 0.35 |
| cMYC.3 | MYC | <0.0001 | 0.68 |
| MVP.1 | MVP | <0.0001 | 0.66 |
| FRAP1.1 | MTOR | <0.0001 | 0.56 |
| MSH3.2 | MSH3 | <0.0001 | 0.47 |
| MSH2.3 | MSH2 | <0.0001 | 0.51 |
| MMP2.1 | MMP2 | 0.0229 | 0.82 |
| STMY3.3 | MMP11 | <0.0001 | 0.66 |
| GBL.1 | MLST8 | 0.0193 | 0.82 |
| MIF.2 | MIF | <0.0001 | 0.69 |
| MICA.1 | MICA | <0.0001 | 0.52 |
| MGMT.1 | MGMT | <0.0001 | 0.50 |
| MCM3.3 | MCM3 | 0.0105 | 0.78 |
| MCAM.1 | MCAM | <0.0001 | 0.41 |
| MARCKS.1 | MARCKS | 0.0259 | 0.82 |
| ERK1.3 | MAPK3 | <0.0001 | 0.35 |
| ERK2.3 | MAPK1 | <0.0001 | 0.61 |
| MAP4.1 | MAP4 | <0.0001 | 0.54 |
| MAP2K3.1 | MAP2K3 | <0.0001 | 0.52 |
| MAP2K1.1 | MAP2K1 | 0.0172 | 0.81 |
| MAL2.1 | MAL2 | 0.0267 | 0.82 |
| MAL.1 | MAL | <0.0001 | 0.46 |
| LTF.1 | LTF | 0.0038 | 0.74 |
| LRP2.1 | LRP2 | <0.0001 | 0.52 |
| LMO2.1 | LMO2 | <0.0001 | 0.60 |
| LDB2.1 | LDB2 | <0.0001 | 0.26 |
| LDB1.2 | LDB1 | <0.0001 | 0.52 |
| LAMA4.1 | LAMA4 | <0.0001 | 0.67 |
| KRT7.1 | KRT7 | <0.0001 | 0.56 |
| K-ras.10 | KRAS | <0.0001 | 0.48 |
| KL.1 | KL | <0.0001 | 0.34 |
| Kitlng.4 | KITLG | <0.0001 | 0.46 |
| c-kit.2 | KIT | <0.0001 | 0.41 |

TABLE 6b-continued

Proxy genes for which increased expression is associated with the absence of necrosis (p-value ≤ .05)

| Gene | Official Symbol | CCF Necrosis p-value | OR |
|---|---|---|---|
| KDR.6 | KDR | <0.0001 | 0.28 |
| KCNJ15.1 | KCNJ15 | <0.0001 | 0.43 |
| HTATIP.1 | KAT5 | <0.0001 | 0.27 |
| G-Catenin.1 | JUP | <0.0001 | 0.32 |
| AP-1 (JUN official).2 | JUN | <0.0001 | 0.64 |
| JAG1.1 | JAG1 | <0.0001 | 0.23 |
| ITGB5.1 | ITGB5 | <0.0001 | 0.64 |
| ITGB3.1 | ITGB3 | 0.0468 | 0.84 |
| ITGB1.1 | ITGB1 | <0.0001 | 0.59 |
| ITGA7.1 | ITGA7 | <0.0001 | 0.38 |
| ITGA6.2 | ITGA6 | <0.0001 | 0.40 |
| ITGA5.1 | ITGA5 | 0.0298 | 0.83 |
| ITGA4.2 | ITGA4 | <0.0001 | 0.61 |
| ITGA3.2 | ITGA3 | 0.0018 | 0.76 |
| IQGAP2.1 | IQGAP2 | <0.0001 | 0.52 |
| INSR.1 | INSR | <0.0001 | 0.38 |
| IMP3.1 | IMP3 | <0.0001 | 0.53 |
| IL6ST.3 | IL6ST | <0.0001 | 0.36 |
| IL15.1 | IL15 | <0.0001 | 0.67 |
| IGFBP6.1 | IGFBP6 | <0.0001 | 0.66 |
| IGF2.2 | IGF2 | 0.0117 | 0.79 |
| IGF1R.3 | IGF1R | <0.0001 | 0.38 |
| ID3.1 | ID3 | <0.0001 | 0.44 |
| ID2.4 | ID2 | <0.0001 | 0.68 |
| ID1.1 | ID1 | <0.0001 | 0.32 |
| ICAM2.1 | ICAM2 | <0.0001 | 0.47 |
| HYAL2.1 | HYAL2 | <0.0001 | 0.28 |
| HYAL1.1 | HYAL1 | <0.0001 | 0.39 |
| HSPG2.1 | HSPG2 | <0.0001 | 0.33 |
| HSP90AB1.1 | HSP90AB1 | 0.0004 | 0.73 |
| HSD11B2.1 | HSD11B2 | <0.0001 | 0.32 |
| Hepsin.1 | HPN | <0.0001 | 0.59 |
| HPCAL1.1 | HPCAL1 | <0.0001 | 0.68 |
| HMGB1.1 | HMGB1 | <0.0001 | 0.42 |
| HLA-DPB1.1 | HLA-DPB1 | 0.0002 | 0.72 |
| HIF1AN.1 | HIF1AN | <0.0001 | 0.54 |
| HDAC1.1 | HDAC1 | <0.0001 | 0.55 |
| HAVCR1.1 | HAVCR1 | 0.0012 | 0.76 |
| HADH.1 | HADH | <0.0001 | 0.49 |
| GSTT1.3 | GSTT1 | 0.0067 | 0.80 |
| GSTp.3 | GSTP1 | <0.0001 | 0.55 |
| GSTM3.2 | GSTM3 | <0.0001 | 0.48 |
| GSTM1.1 | GSTM1 | <0.0001 | 0.54 |
| GRB7.2 | GRB7 | <0.0001 | 0.49 |
| GPX3.1 | GPX3 | <0.0001 | 0.59 |
| GPC3.1 | GPC3 | 0.0287 | 0.81 |
| GJA1.1 | GJA1 | 0.0004 | 0.74 |
| GFRA1.1 | GFRA1 | 0.0011 | 0.74 |
| GCLC.3 | GCLC | <0.0001 | 0.50 |
| GATM.1 | GATM | <0.0001 | 0.45 |
| GATA3.3 | GATA3 | 0.0159 | 0.79 |
| GADD45B.1 | GADD45B | <0.0001 | 0.67 |
| FOS.1 | FOS | <0.0001 | 0.56 |
| FOLR1.1 | FOLR1 | <0.0001 | 0.59 |
| FLT4.1 | FLT4 | <0.0001 | 0.27 |
| FLT3LG.1 | FLT3LG | <0.0001 | 0.62 |
| FLT1.1 | FLT1 | <0.0001 | 0.32 |
| FILIP1.1 | FILIP1 | <0.0001 | 0.42 |
| FIGF.1 | FIGF | 0.0001 | 0.62 |
| FHL1.1 | FHL1 | <0.0001 | 0.36 |
| FHIT.1 | FHIT | <0.0001 | 0.63 |
| FH.1 | FH | <0.0001 | 0.65 |
| FGFR2 isoform 1.1 | FGFR2 | <0.0001 | 0.51 |
| FGFR1.3 | FGFR1 | <0.0001 | 0.55 |
| FGF2.2 | FGF2 | <0.0001 | 0.61 |
| FGF1.1 | FGF1 | <0.0001 | 0.49 |
| FDPS.1 | FDPS | <0.0001 | 0.43 |
| FBXW7.1 | FBXW7 | <0.0001 | 0.60 |
| fas.1 | FAS | 0.0054 | 0.79 |
| ESRRG.3 | ESRRG | <0.0001 | 0.68 |
| ERG.1 | ERG | <0.0001 | 0.34 |
| ERCC4.1 | ERCC4 | 0.0197 | 0.81 |
| ERCC1.2 | ERCC1 | <0.0001 | 0.60 |
| ERBB4.3 | ERBB4 | 0.0037 | 0.72 |
| ErbB3.1 | ERBB3 | <0.0001 | 0.59 |
| HER2.3 | ERBB2 | <0.0001 | 0.40 |
| EPHB4.1 | EPHB4 | <0.0001 | 0.44 |
| EPHA2.1 | EPHA2 | <0.0001 | 0.36 |
| EPAS1.1 | EPAS1 | <0.0001 | 0.29 |
| ENPP2.1 | ENPP2 | <0.0001 | 0.50 |
| ENPEP.1 | ENPEP | <0.0001 | 0.56 |
| CD105.1 | ENG | <0.0001 | 0.31 |
| EMP1.1 | EMP1 | <0.0001 | 0.49 |
| EMCN.1 | EMCN | <0.0001 | 0.23 |
| ELTD1.1 | ELTD1 | <0.0001 | 0.59 |
| EIF2C1.1 | EIF2C1 | <0.0001 | 0.52 |
| EGR1.1 | EGR1 | <0.0001 | 0.54 |
| EGLN3.1 | EGLN3 | <0.0001 | 0.69 |
| EGFR.2 | EGFR | <0.0001 | 0.70 |
| EFNB2.1 | EFNB2 | <0.0001 | 0.34 |
| EFNB1.2 | EFNB1 | <0.0001 | 0.41 |
| EEF1A1.1 | EEF1A1 | <0.0001 | 0.32 |
| EDNRB.1 | EDNRB | <0.0001 | 0.31 |
| EDN2.1 | EDN2 | <0.0001 | 0.51 |
| EDN1 endothelin.1 | EDN1 | <0.0001 | 0.41 |
| EBAG9.1 | EBAG9 | 0.0007 | 0.74 |
| DUSP1.1 | DUSP1 | <0.0001 | 0.65 |
| DPYS.1 | DPYS | <0.0001 | 0.66 |
| DPEP1.1 | DPEP1 | <0.0001 | 0.34 |
| DLL4.1 | DLL4 | <0.0001 | 0.49 |
| DLC1.1 | DLC1 | <0.0001 | 0.36 |
| DKFZP564O0823.1 | DKFZP564O0823 | <0.0001 | 0.35 |
| DICER1.2 | DICER1 | <0.0001 | 0.46 |
| DIAPH1.1 | DIAPH1 | <0.0001 | 0.63 |
| DIABLO.1 | DIABLO | 0.0002 | 0.72 |
| DHPS.3 | DHPS | <0.0001 | 0.46 |
| DET1.1 | DET1 | <0.0001 | 0.61 |
| DEFB1.1 | DEFB1 | <0.0001 | 0.69 |
| DDC.1 | DDC | <0.0001 | 0.51 |
| DCXR.1 | DCXR | 0.0061 | 0.78 |
| DAPK1.3 | DAPK1 | <0.0001 | 0.47 |
| CYR61.1 | CYR61 | <0.0001 | 0.52 |
| CYP3A4.2 | CYP3A4 | 0.0398 | 0.82 |
| CYP2C8v2.1 | CYP2C8_21 | <0.0001 | 0.67 |
| CXCL12.1 | CXCL12 | <0.0001 | 0.53 |
| CX3CR1.1 | CX3CR1 | <0.0001 | 0.60 |
| CX3CL1.1 | CX3CL1 | <0.0001 | 0.34 |
| CUL1.1 | CUL1 | <0.0001 | 0.62 |
| CUBN.1 | CUBN | <0.0001 | 0.39 |
| CTSH.2 | CTSH | 0.0018 | 0.77 |
| B-Catenin.3 | CTNNB1 | <0.0001 | 0.38 |
| A-Catenin.2 | CTNNA1 | <0.0001 | 0.58 |
| CTGF.1 | CTGF | <0.0001 | 0.64 |
| CSF1R.2 | CSF1R | 0.0308 | 0.83 |
| CSF1.1 | CSF1 | 0.0002 | 0.73 |
| CRADD.1 | CRADD | <0.0001 | 0.60 |
| COL4A2.1 | COL4A2 | <0.0001 | 0.51 |
| COL4A1.1 | COL4A1 | <0.0001 | 0.66 |
| COL18A1.1 | COL18A1 | <0.0001 | 0.50 |
| CLU.3 | CLU | 0.0091 | 0.80 |
| CLDN7.2 | CLDN7 | 0.0029 | 0.76 |
| CLDN10.1 | CLDN10 | <0.0001 | 0.48 |
| CLCNKB.1 | CLCNKB | 0.0001 | 0.61 |
| CFLAR.1 | CFLAR | <0.0001 | 0.47 |
| CEACAM1.1 | CEACAM1 | <0.0001 | 0.43 |
| p27.3 | CDKN1B | 0.0002 | 0.73 |
| p21.3 | CDKN1A | <0.0001 | 0.65 |
| CDH6.1 | CDH6 | <0.0001 | 0.67 |
| CDH5.1 | CDH5 | <0.0001 | 0.33 |
| CDH2.1 | CDH2 | 0.0003 | 0.75 |
| CDH16.1 | CDH16 | <0.0001 | 0.51 |
| CDH13.1 | CDH13 | <0.0001 | 0.39 |
| CD36.1 | CD36 | <0.0001 | 0.41 |

TABLE 6b-continued

Proxy genes for which increased expression is associated with the absence of necrosis (p-value ≤ .05)

| Gene | Official Symbol | CCF Necrosis p-value | OR |
|---|---|---|---|
| CD34.1 | CD34 | <0.0001 | 0.34 |
| CD24.1 | CD24 | 0.0148 | 0.81 |
| CCND1.3 | CCND1 | <0.0001 | 0.51 |
| MCP1.1 | CCL2 | <0.0001 | 0.68 |
| CAT.1 | CAT | <0.0001 | 0.48 |
| CASP10.1 | CASP10 | <0.0001 | 0.62 |
| CALD1.2 | CALD1 | <0.0001 | 0.42 |
| CACNA2D1.1 | CACNA2D1 | 0.0006 | 0.74 |
| CA2.1 | CA2 | <0.0001 | 0.60 |
| C7.1 | C7 | <0.0001 | 0.65 |
| ECRG4.1 | C2orf40 | <0.0001 | 0.32 |
| C13orf15.1 | C13orf15 | <0.0001 | 0.31 |
| BUB3.1 | BUB3 | <0.0001 | 0.65 |
| BTRC.1 | BTRC | <0.0001 | 0.63 |
| BNIP3.1 | BNIP3 | 0.0021 | 0.77 |
| CIAP1.2 | BIRC2 | <0.0001 | 0.56 |
| BIN1.3 | BIN1 | <0.0001 | 0.67 |
| BGN.1 | BGN | <0.0001 | 0.47 |
| BCL2L12.1 | BCL2L12 | 0.0374 | 0.82 |
| Bclx.2 | BCL2L1 | <0.0001 | 0.60 |
| Bcl2.2 | BCL2 | <0.0001 | 0.31 |
| BAG1.2 | BAG1 | <0.0001 | 0.42 |
| BAD.1 | BAD | 0.0187 | 0.82 |
| AXL.1 | AXL | 0.0077 | 0.79 |
| ATP6V1B1.1 | ATP6V1B1 | <0.0001 | 0.52 |
| ASS1.1 | ASS1 | <0.0001 | 0.61 |
| ARRB1.1 | ARRB1 | <0.0001 | 0.48 |
| ARHGDIB.1 | ARHGDIB | <0.0001 | 0.48 |
| ARF1.1 | ARF1 | 0.0021 | 0.75 |
| AQP1.1 | AQP1 | <0.0001 | 0.28 |
| APOLD1.1 | APOLD1 | <0.0001 | 0.35 |
| APC.4 | APC | <0.0001 | 0.55 |
| APAF1.2 | APAF1 | 0.0264 | 0.82 |
| ANXA4.1 | ANXA4 | 0.0012 | 0.76 |
| ANXA1.2 | ANXA1 | 0.0201 | 0.81 |
| ANTXR1.1 | ANTXR1 | <0.0001 | 0.58 |
| ANGPTL4.1 | ANGPTL4 | <0.0001 | 0.71 |
| ANGPTL3.3 | ANGPTL3 | 0.0104 | 0.77 |
| ANGPTL2.1 | ANGPTL2 | <0.0001 | 0.63 |
| ANGPT2.1 | ANGPT2 | <0.0001 | 0.65 |
| ANGPT1.1 | ANGPT1 | <0.0001 | 0.30 |
| AMACR1.1 | AMACR | 0.0080 | 0.79 |
| ALDOB.1 | ALDOB | <0.0001 | 0.40 |
| ALDH6A1.1 | ALDH6A1 | <0.0001 | 0.38 |
| ALDH4.2 | ALDH4A1 | 0.0001 | 0.71 |
| AKT3.2 | AKT3 | <0.0001 | 0.30 |
| AKT2.3 | AKT2 | <0.0001 | 0.53 |
| AKT1.3 | AKT1 | <0.0001 | 0.47 |
| AHR.1 | AHR | <0.0001 | 0.60 |
| AGTR1.1 | AGTR1 | <0.0001 | 0.33 |
| AGT.1 | AGT | 0.0032 | 0.77 |
| ADH6.1 | ADH6 | 0.0011 | 0.71 |
| ADH1B.1 | ADH1B | <0.0001 | 0.69 |
| ADFP.1 | ADFP | 0.0001 | 0.73 |
| ADD1.1 | ADD1 | <0.0001 | 0.33 |
| ADAMTS9.1 | ADAMTS9 | <0.0001 | 0.69 |
| ADAMTS5.1 | ADAMTS5 | <0.0001 | 0.55 |
| ADAMTS1.1 | ADAMTS1 | <0.0001 | 0.56 |
| ADAM17.1 | ADAM17 | 0.0009 | 0.76 |
| ACE2.1 | ACE2 | <0.0001 | 0.45 |
| ACADSB.1 | ACADSB | <0.0001 | 0.46 |
| BCRP.1 | ABCG2 | <0.0001 | 0.27 |
| MRP4.2 | ABCC4 | <0.0001 | 0.61 |
| MRP3.1 | ABCC3 | 0.0011 | 0.76 |
| MRP1.1 | ABCC1 | 0.0008 | 0.75 |
| ABCB1.5 | ABCB1 | <0.0001 | 0.59 |
| NPD009 (ABAT official).3 | ABAT | 0.0001 | 0.70 |
| AAMP.1 | AAMP | <0.0001 | 0.62 |
| A2M.1 | A2M | <0.0001 | 0.28 |

TABLE 7a

Proxy genes for which increased expression is associated with the presence of nodal invasion (p-value ≤ .05)

| Gene | Official Symbol | Nodal Invasion p-value | OR |
|---|---|---|---|
| TUBB.1 | TUBB2A | 0.0242 | 2.56 |
| C20 orf1.1 | TPX2 | 0.0333 | 2.61 |
| TK1.2 | TK1 | 0.0361 | 1.75 |
| SPHK1.1 | SPHK1 | 0.0038 | 3.43 |
| SLC7A5.2 | SLC7A5 | 0.0053 | 4.85 |
| SILV.1 | SILV | 0.0470 | 1.54 |
| SELE.1 | SELE | 0.0311 | 1.93 |
| upa.3 | PLAU | 0.0450 | 2.78 |
| MMP9.1 | MMP9 | 0.0110 | 2.65 |
| MMP7.1 | MMP7 | 0.0491 | 2.34 |
| MMP14.1 | MMP14 | 0.0155 | 3.21 |
| LAMB1.1 | LAMB1 | 0.0247 | 3.04 |
| IL-8.1 | IL8 | 0.0019 | 3.18 |
| IL6.3 | IL6 | 0.0333 | 2.31 |
| HSPA1A.1 | HSPA1A | 0.0498 | 2.11 |
| GSTp.3 | GSTP1 | 0.0272 | 3.46 |
| GRB14.1 | GRB14 | 0.0287 | 2.32 |
| GMNN.1 | GMNN | 0.0282 | 3.00 |
| ENO2.1 | ENO2 | 0.0190 | 3.43 |
| CCNB1.2 | CCNB1 | 0.0387 | 1.87 |
| BUB1.1 | BUB1 | 0.0429 | 2.21 |
| BAG2.1 | BAG2 | 0.0346 | 2.54 |
| ADAMTS1.1 | ADAMTS1 | 0.0193 | 3.31 |

TABLE 7b

Proxy genes for which increased expression is associated with the absence of nodal invasion (p-value ≤ .05)

| Gene | Official Symbol | Nodal Invasion p-value | OR |
|---|---|---|---|
| VWF.1 | VWF | 0.0221 | 0.42 |
| VCAM1.1 | VCAM1 | 0.0212 | 0.42 |
| UBE1C.1 | UBA3 | 0.0082 | 0.32 |
| tusc4.2 | TUSC4 | 0.0050 | 0.28 |
| TSPAN7.2 | TSPAN7 | 0.0407 | 0.43 |
| TSC1.1 | TSC1 | 0.0372 | 0.38 |
| TMSB10.1 | TMSB10 | 0.0202 | 0.43 |
| TMEM47.1 | TMEM47 | 0.0077 | 0.32 |
| TMEM27.1 | TMEM27 | 0.0431 | 0.41 |
| TLR3.1 | TLR3 | 0.0041 | 0.32 |
| TIMP3.3 | TIMP3 | 0.0309 | 0.40 |
| TGFBR2.3 | TGFBR2 | 0.0296 | 0.35 |
| TGFB2.2 | TGFB2 | 0.0371 | 0.30 |
| TGFA.2 | TGFA | 0.0025 | 0.32 |
| TEK.1 | TEK | 0.0018 | 0.09 |
| TCF4.1 | TCF4 | 0.0088 | 0.38 |
| STAT5A.1 | STAT5A | 0.0129 | 0.49 |
| SPRY1.1 | SPRY1 | 0.0188 | 0.43 |
| SPARCL1.1 | SPARCL1 | 0.0417 | 0.50 |
| SOD1.1 | SOD1 | 0.0014 | 0.23 |
| SNRK.1 | SNRK | 0.0226 | 0.43 |
| MADH2.1 | SMAD2 | 0.0098 | 0.37 |
| SLC22A6.1 | SLC22A6 | 0.0051 | 0.00 |
| PTPNS1.1 | SIRPA | 0.0206 | 0.43 |
| SHANK3.1 | SHANK3 | 0.0024 | 0.30 |
| SGK.1 | SGK1 | 0.0087 | 0.35 |
| SELENBP1.1 | SELENBP1 | 0.0016 | 0.29 |
| SCN4B.1 | SCN4B | 0.0081 | 0.08 |
| ROCK1.1 | ROCK1 | 0.0058 | 0.41 |
| RhoB.1 | RHOB | 0.0333 | 0.43 |
| RGS5.1 | RGS5 | 0.0021 | 0.31 |
| FLJ22655.1 | RERGL | 0.0009 | 0.01 |
| RB1.1 | RB1 | 0.0281 | 0.48 |
| RASSF1.1 | RASSF1 | 0.0004 | 0.23 |
| PTPRB.1 | PTPRB | 0.0154 | 0.40 |
| PTK2.1 | PTK2 | 0.0158 | 0.38 |
| PTHR1.1 | PTH1R | <0.0001 | 0.01 |
| PRSS8.1 | PRSS8 | 0.0023 | 0.10 |
| PRKCH.1 | PRKCH | 0.0475 | 0.48 |

TABLE 7b-continued

Proxy genes for which increased expression is associated with the absence of nodal invasion (p-value ≤ .05)

| Gene | Official Symbol | Nodal Invasion p-value | OR |
|---|---|---|---|
| PPAP2B.1 | PPAP2B | 0.0110 | 0.40 |
| PLA2G4C.1 | PLA2G4C | 0.0002 | 0.03 |
| PI3K.2 | PIK3C2B | 0.0138 | 0.13 |
| PFKP.1 | PFKP | 0.0040 | 0.41 |
| CD31.3 | PECAM1 | 0.0077 | 0.38 |
| PDGFD.2 | PDGFD | 0.0169 | 0.35 |
| PDGFC.3 | PDGFC | 0.0053 | 0.36 |
| PDGFB.3 | PDGFB | 0.0359 | 0.47 |
| PCSK6.1 | PCSK6 | 0.0103 | 0.34 |
| PCK1.1 | PCK1 | 0.0003 | 0.02 |
| PCCA.1 | PCCA | 0.0074 | 0.12 |
| PARD6A.1 | PARD6A | 0.0243 | 0.21 |
| BFGF.3 | NUDT6 | 0.0082 | 0.15 |
| NRG1.3 | NRG1 | 0.0393 | 0.19 |
| NOS3.1 | NOS3 | 0.0232 | 0.34 |
| NOS2A.3 | NOS2 | 0.0086 | 0.11 |
| NFX1.1 | NFX1 | 0.0065 | 0.35 |
| MYH11.1 | MYH11 | 0.0149 | 0.36 |
| cMYC.3 | MYC | 0.0472 | 0.46 |
| MUC1.2 | MUC1 | 0.0202 | 0.26 |
| MIF.2 | MIF | 0.0145 | 0.39 |
| MICA.1 | MICA | 0.0015 | 0.15 |
| MGMT.1 | MGMT | 0.0414 | 0.50 |
| MAP2K1.1 | MAP2K1 | 0.0075 | 0.40 |
| LMO2.1 | LMO2 | 0.0127 | 0.07 |
| LDB2.1 | LDB2 | 0.0048 | 0.33 |
| Kitlng.4 | KITLG | 0.0146 | 0.18 |
| KDR.6 | KDR | 0.0106 | 0.34 |
| ITGB1.1 | ITGB1 | 0.0469 | 0.36 |
| ITGA7.1 | ITGA7 | 0.0290 | 0.38 |
| ITGA6.2 | ITGA6 | 0.0010 | 0.17 |
| ITGA4.2 | ITGA4 | 0.0089 | 0.44 |
| INSR.1 | INSR | 0.0057 | 0.32 |
| IMP3.1 | IMP3 | 0.0086 | 0.43 |
| IL6ST.3 | IL6ST | 0.0484 | 0.46 |
| IL15.1 | IL15 | 0.0009 | 0.08 |
| IFI27.1 | IFI27 | 0.0013 | 0.22 |
| HYAL2.1 | HYAL2 | 0.0099 | 0.36 |
| HYAL1.1 | HYAL1 | 0.0001 | 0.08 |
| Hepsin.1 | HPN | 0.0024 | 0.14 |
| HPCAL1.1 | HPCAL1 | 0.0024 | 0.38 |
| HMGB1.1 | HMGB1 | 0.0385 | 0.45 |
| HLA-DPB1.1 | HLA-DPB1 | 0.0398 | 0.43 |
| HADH.1 | HADH | 0.0093 | 0.33 |
| GSTM1.1 | GSTM1 | 0.0018 | 0.18 |
| GPX2.2 | GPX2 | 0.0211 | 0.07 |
| GJA1.1 | GJA1 | 0.0451 | 0.46 |
| GATM.1 | GATM | 0.0038 | 0.25 |
| GATA3.3 | GATA3 | 0.0188 | 0.06 |
| FOLR1.1 | FOLR1 | 0.0152 | 0.32 |
| FLT4.1 | FLT4 | 0.0125 | 0.22 |
| FLT1.1 | FLT1 | 0.0046 | 0.35 |
| FHL1.1 | FHL1 | 0.0435 | 0.47 |
| FHIT.1 | FHIT | 0.0061 | 0.29 |
| fas.1 | FAS | 0.0163 | 0.39 |
| ErbB3.1 | ERBB3 | 0.0145 | 0.33 |
| EPHA2.1 | EPHA2 | 0.0392 | 0.37 |
| EPAS1.1 | EPAS1 | 0.0020 | 0.28 |
| ENPEP.1 | ENPEP | 0.0002 | 0.34 |
| CD105.1 | ENG | 0.0112 | 0.38 |
| EMCN.1 | EMCN | 0.0022 | 0.19 |
| EIF2C1.1 | EIF2C1 | 0.0207 | 0.33 |
| EGLN3.1 | EGLN3 | 0.0167 | 0.52 |
| EFNB2.1 | EFNB2 | 0.0192 | 0.30 |
| EFNB1.2 | EFNB1 | 0.0110 | 0.37 |
| EDNRB.1 | EDNRB | 0.0106 | 0.36 |
| EDN1 endothelin.1 | EDN1 | 0.0440 | 0.42 |
| DPYS.1 | DPYS | 0.0454 | 0.43 |
| DKFZP564O0823.1 | DKFZP564O0823 | 0.0131 | 0.31 |
| DHPS.3 | DHPS | 0.0423 | 0.48 |
| DAPK1.3 | DAPK1 | 0.0048 | 0.39 |
| CYP2C8v2.1 | CYP2C8_21 | 0.0003 | 0.01 |
| CYP2C8.2 | CYP2C8_2 | 0.0269 | 0.07 |
| CX3CR1.1 | CX3CR1 | 0.0224 | 0.13 |
| CUBN.1 | CUBN | 0.0010 | 0.04 |
| CRADD.1 | CRADD | 0.0193 | 0.40 |
| CLDN10.1 | CLDN10 | 0.0005 | 0.21 |
| CFLAR.1 | CFLAR | 0.0426 | 0.49 |
| CEACAM1.1 | CEACAM1 | 0.0083 | 0.23 |
| CDKN2A.2 | CDKN2A | 0.0026 | 0.13 |
| p27.3 | CDKN1B | 0.0393 | 0.60 |
| CDH5.1 | CDH5 | 0.0038 | 0.33 |
| CDH13.1 | CDH13 | 0.0203 | 0.39 |
| CD99.1 | CD99 | 0.0173 | 0.38 |
| CD36.1 | CD36 | 0.0015 | 0.29 |
| CD34.1 | CD34 | 0.0250 | 0.38 |
| CD3z.1 | CD247 | 0.0419 | 0.33 |
| CCND1.3 | CCND1 | 0.0381 | 0.50 |
| CAT.1 | CAT | 0.0044 | 0.42 |
| CASP6.1 | CASP6 | 0.0136 | 0.36 |
| CALD1.2 | CALD1 | 0.0042 | 0.31 |
| CA9.3 | CA9 | 0.0077 | 0.48 |
| C13orf15.1 | C13orf15 | 0.0152 | 0.39 |
| BUB3.1 | BUB3 | 0.0157 | 0.26 |
| BIN1.3 | BIN1 | 0.0224 | 0.38 |
| Bclx.2 | BCL2L1 | 0.0225 | 0.52 |
| Bcl2.2 | BCL2 | 0.0442 | 0.45 |
| AXL.1 | AXL | 0.0451 | 0.44 |
| ATP6V1B1.1 | ATP6V1B1 | 0.0257 | 0.03 |
| ARRB1.1 | ARRB1 | 0.0337 | 0.43 |
| ARHGDIB.1 | ARHGDIB | 0.0051 | 0.32 |
| AQP1.1 | AQP1 | 0.0022 | 0.31 |
| APOLD1.1 | APOLD1 | 0.0222 | 0.42 |
| APC.4 | APC | 0.0165 | 0.47 |
| ANXA5.1 | ANXA5 | 0.0143 | 0.37 |
| ANXA4.1 | ANXA4 | 0.0019 | 0.30 |
| ANXA1.2 | ANXA1 | 0.0497 | 0.39 |
| ANGPTL7.1 | ANGPTL7 | 0.0444 | 0.16 |
| ANGPTL4.1 | ANGPTL4 | 0.0197 | 0.55 |
| ANGPT1.1 | ANGPT1 | 0.0055 | 0.15 |
| ALDOB | ALDOB | 0.0128 | 0.02 |
| ALDH4.2 | ALDH4A1 | 0.0304 | 0.33 |
| AGTR1.1 | AGTR1 | 0.0142 | 0.11 |
| ADH6.1 | ADH6 | 0.0042 | 0.03 |
| ADFP | ADFP | 0.0223 | 0.47 |
| ADD1.1 | ADD1 | 0.0135 | 0.42 |
| BCRP.1 | ABCG2 | 0.0098 | 0.19 |
| MRP3.1 | ABCC3 | 0.0247 | 0.44 |
| MRP1.1 | ABCC1 | 0.0022 | 0.32 |
| NPD009 (ABAT official).3 | ABAT | 0.0110 | 0.19 |
| A2M.1 | A2M | 0.0012 | 0.29 |

TABLE 8a

Genes for which increased expression is associated with lower risk of cancer recurrence after clinical/pathologic covariate adjustment (p < 0.05)

| Gene | Official Symbol | p-value | HR |
|---|---|---|---|
| ACE2.1 | ACE2 | 0.0261 | 0.85 |
| ADD1.1 | ADD1 | 0.0339 | 0.85 |
| ALDOB.1 | ALDOB | 0.0328 | 0.84 |
| ANGPTL3.3 | ANGPTL3 | 0.0035 | 0.79 |
| APOLD1.1 | APOLD1 | 0.0015 | 0.78 |
| AQP1.1 | AQP1 | 0.0014 | 0.79 |
| BFGF.3 | NUDT6 | 0.0010 | 0.77 |
| CASP10.1 | CASP10 | 0.0024 | 0.82 |
| CAV2.1 | CAV2 | 0.0191 | 0.86 |
| CCL4.2 | CCL4 | 0.0045 | 0.81 |
| CCL5.2 | CCL5 | 0.0003 | 0.78 |
| CCR2.1 | CCR2 | 0.0390 | 0.87 |

TABLE 8a-continued

Genes for which increased expression is associated with lower risk of cancer recurrence after clinical/pathologic covariate adjustment (p < 0.05)

| Gene | Official Symbol | p-value | HR |
|---|---|---|---|
| CCR4.2 | CCR4 | 0.0109 | 0.82 |
| CCR7.1 | CCR7 | 0.0020 | 0.80 |
| CD4.1 | CD4 | 0.0195 | 0.86 |
| CD8A.1 | CD8A | 0.0058 | 0.83 |
| CEACAM1.1 | CEACAM1 | 0.0022 | 0.81 |
| CFLAR.1 | CFLAR | 0.0308 | 0.87 |
| CTSS.1 | CTSS | 0.0462 | 0.87 |
| CX3CL1.1 | CX3CL1 | 0.0021 | 0.81 |
| CXCL10.1 | CXCL10 | 0.0323 | 0.86 |
| CXCL9.1 | CXCL9 | 0.0006 | 0.79 |
| CXCR6.1 | CXCR6 | 0.0469 | 0.88 |
| DAPK1.3 | DAPK1 | 0.0050 | 0.83 |
| DDC.1 | DDC | 0.0307 | 0.86 |
| DLC1.1 | DLC1 | 0.0249 | 0.83 |
| ECRG4.1 | C2orf40 | 0.0244 | 0.84 |
| EDNRB.1 | EDNRB | 0.0400 | 0.86 |
| EMCN.1 | EMCN | <0.0001 | 0.68 |
| EPAS1.1 | EPAS1 | 0.0411 | 0.84 |
| fas.1 | FAS | 0.0242 | 0.87 |
| FH.1 | FH | 0.0407 | 0.88 |
| GATA3.3 | GATA3 | 0.0172 | 0.83 |
| GZMA.1 | GZMA | 0.0108 | 0.84 |
| HLA-DPB1.1 | HLA-DPB1 | 0.0036 | 0.82 |
| HSPG2.1 | HSPG2 | 0.0236 | 0.84 |
| ICAM2.1 | ICAM2 | 0.0091 | 0.83 |
| ICAM3.1 | ICAM3 | 0.0338 | 0.87 |
| ID1.1 | ID1 | 0.0154 | 0.83 |
| IGF1R.3 | IGF1R | 0.0281 | 0.85 |
| IL15.1 | IL15 | 0.0059 | 0.83 |
| IQGAP2.1 | IQGAP2 | 0.0497 | 0.88 |
| KL.1 | KL | 0.0231 | 0.86 |
| KLRK1.2 | KLRK1 | 0.0378 | 0.87 |
| LDB2.1 | LDB2 | 0.0092 | 0.82 |
| LRP2.1 | LRP2 | 0.0193 | 0.86 |
| LTF.1 | LTF | 0.0077 | 0.82 |
| MAP4.1 | MAP4 | 0.0219 | 0.84 |
| MRP1.1 | ABCC1 | 0.0291 | 0.87 |
| NOS3.1 | NOS3 | 0.0008 | 0.78 |
| PI3K.2 | PIK3C2B | 0.0329 | 0.83 |
| PLA2G4C.1 | PLA2G4C | 0.0452 | 0.87 |
| PPAP2B.1 | PPAP2B | 0.0001 | 0.74 |
| PRCC.1 | PRCC | 0.0333 | 0.88 |
| PRKCB1.1 | PRKCB | 0.0353 | 0.87 |
| PRKCH.1 | PRKCH | 0.0022 | 0.82 |
| PRSS8.1 | PRSS8 | 0.0332 | 0.87 |
| PSMB9.1 | PSMB9 | 0.0262 | 0.87 |
| PTPRB.1 | PTPRB | 0.0030 | 0.80 |
| RGS5.1 | RGS5 | 0.0480 | 0.85 |
| SDPR.1 | SDPR | 0.0045 | 0.80 |
| SELE.1 | SELE | 0.0070 | 0.81 |
| SGK.1 | SGK1 | 0.0100 | 0.83 |
| SHANK3.1 | SHANK3 | 0.0311 | 0.84 |
| SNRK.1 | SNRK | 0.0026 | 0.81 |
| TEK.1 | TEK | 0.0059 | 0.78 |
| TGFBR2.3 | TGFBR2 | 0.0343 | 0.85 |
| TIMP3.3 | TIMP3 | 0.0165 | 0.83 |
| TMEM27.1 | TMEM27 | 0.0249 | 0.86 |
| TSPAN7.2 | TSPAN7 | 0.0099 | 0.83 |
| UBB.1 | UBB | 0.0144 | 0.85 |
| WWOX.5 | WWOX | 0.0082 | 0.83 |

TABLE 8b

Genes for which increased expression is associated with higher risk of cancer recurrence after clinical/pathologic covariate adjustment (p < 0.05)

| Gene | Official Symbol | p-value | HR |
|---|---|---|---|
| CIAP1.2 | BIRC2 | 0.0425 | 1.14 |
| BUB1.1 | BUB1 | 0.0335 | 1.15 |
| CCNB1.2 | CCNB1 | 0.0296 | 1.14 |
| ENO2.1 | ENO2 | 0.0284 | 1.17 |
| ITGB1.1 | ITGB1 | 0.0402 | 1.16 |
| ITGB5.1 | ITGB5 | 0.0016 | 1.25 |
| LAMB1.1 | LAMB1 | 0.0067 | 1.20 |
| MMP14.1 | MMP14 | 0.0269 | 1.16 |
| MMP9.1 | MMP9 | 0.0085 | 1.19 |
| PSMA7.1 | PSMA7 | 0.0167 | 1.16 |
| RUNX1.1 | RUNX1 | 0.0491 | 1.15 |
| SPHK1.1 | SPHK1 | 0.0278 | 1.16 |
| OPN, osteopontin.3 | SPP1 | 0.0134 | 1.17 |
| SQSTM1.1 | SQSTM1 | 0.0347 | 1.13 |
| C20 orf1.1 | TPX2 | 0.0069 | 1.20 |
| TUBB.1 | TUBB2A | 0.0046 | 1.21 |
| VCAN.1 | VCAN | 0.0152 | 1.18 |

TABLE 9

16 Significant Genes After Adjusting for Clinical/Pathologic Covariates and Allowing for an FDR of 10%

| Official Symbol | n | Gene Subset (Pathway) | HR | HR (95% CI) | LR ChiSq | LR p-value | q-value |
|---|---|---|---|---|---|---|---|
| EMCN | 928 | Angiogenesis | 0.68 | (0.57, 0.80) | 19.87 | <0.0001 | 0.0042 |
| PPAP2B | 928 | Angiogenesis | 0.74 | (0.65, 0.85) | 16.15 | 0.0001 | 0.0148 |
| CCL5 | 928 | Immune Response | 0.78 | (0.68, 0.89) | 12.98 | 0.0003 | 0.0529 |
| CXCL9 | 928 | Immune Response | 0.79 | (0.70, 0.91) | 11.74 | 0.0006 | 0.0772 |
| NOS3 | 928 | Angiogenesis | 0.78 | (0.68, 0.90) | 11.32 | 0.0008 | 0.0774 |
| NUDT6 | 926 | Angiogenesis | 0.77 | (0.66, 0.90) | 10.77 | 0.0010 | 0.0850 |
| AQP1 | 928 | Transport | 0.79 | (0.69, 0.91) | 10.15 | 0.0014 | 0.0850 |
| APOLD1 | 927 | Angiogenesis | 0.78 | (0.68, 0.91) | 10.07 | 0.0015 | 0.0850 |
| ITGB5 | 928 | Cell Adhesion/ Extracellular Matrix | 1.25 | (1.09, 1.43) | 9.92 | 0.0016 | 0.0850 |
| CCR7 | 928 | Immune Response | 0.80 | (0.69, 0.92) | 9.58 | 0.0020 | 0.0850 |
| CX3CL1 | 926 | Immune Response | 0.81 | (0.70, 0.92) | 9.44 | 0.0021 | 0.0850 |
| CEACAM1 | 928 | Angiogenesis | 0.81 | (0.70, 0.93) | 9.37 | 0.0022 | 0.0850 |
| PRKCH | 917 | Angiogenesis | 0.82 | (0.72, 0.93) | 9.36 | 0.0022 | 0.0850 |
| CASP10 | 927 | Apoptosis | 0.82 | (0.73, 0.93) | 9.25 | 0.0024 | 0.0850 |
| SNRK | 928 | Angiogenesis | 0.81 | (0.71, 0.92) | 9.09 | 0.0026 | 0.0863 |
| PTPRB | 927 | Angiogenesis | 0.80 | (0.69, 0.92) | 8.83 | 0.0030 | 0.0933 |

TABLE A

| Gene | Accession Num | Sequence_ID | Official Symbol | Gene Version ID | F Primer Seq | SEQ ID NO. | R Primer Seq | SEQ ID NO. | Probe Seq | SEQ ID NO. |
|---|---|---|---|---|---|---|---|---|---|---|
| A-Catenin.2 | NM_001903 | NM_001903.1 | CTNNA1 | 765 | CGTTCCGATCTCT ATACTGCAT | 1 | AGGTCCCTGTTG GCCTTATAGG | 733 | ATGCCTACAGCACCC TGATGTCGCA | 1465 |
| A2M.1 | NM_000014 | NM_000014.4 | A2M | 6456 | CTCTCCCGCCTTCC TAGC | 2 | CCGTTTGCACAG ATGCAG | 734 | CGTTGTTCCTTCTC CACTGGGAC | 1466 |
| AAMP.1 | NM_001087 | NM_001087.3 | AAMP | 5474 | GTGTGGCAGGTGG ACACTAA | 3 | CTCCATCCACTC CAGTCTC | 735 | CGCTTCAAAGGACCA GACTCCTC | 1467 |
| ABCB1.5 | NM_000927 | NM_000927.2 | ABCB1 | 3099 | AAACACCACTGGAG CATTGA | 4 | CAAGCCTGGAAC CTATAGCC | 736 | CTCGCCAATGATGCT GCTCAAGTT | 1468 |
| ACADSB.1 | NM_001609 | NM_001609.3 | ACADSB | 6278 | TGGCGGAGAACTA GCCAT | 5 | AAGACAGCCCAG TCCTCAAAT | 737 | CCTCCTGAAGCCTG CCATCATTGT | 1469 |
| ACE.1 | NM_000789 | NM_000789.2 | ACE | 4257 | CCGCTGTACGAGG ATTTCA | 6 | CCGTGTCTGTGA AGCCGT | 738 | TGCCCTCAGCAATGA AGCCTACAA | 1470 |
| ACE2.1 | NM_021804 | NM_021804.1 | ACE2 | 6108 | TACAATGAGAGGCT CTGGGC | 7 | TAATGGCCTCAG CTGCTTG | 739 | CGACCTCAGATCTCC AGCTTTCCC | 1471 |
| ADAM17.1 | NM_003183 | NM_003183.3 | ADAM17 | 2617 | GAAGTGCCAGGAG GCGATTA | 8 | CGGGCACTCACT GCTATTACC | 740 | TGTACTTGCAAAGG CGTGTCCTACTGC | 1472 |
| ADAM8.1 | NM_001109 | NM_001109.2 | ADAM8 | 3978 | GTCACTGTGTCCAG CCCA | 9 | TGATGACCTGCT TTGGTGC | 741 | TTCCCAGTTCCTGTC TACACCGG | 1473 |
| ADAMTS1.1 | NM_006988 | NM_006988.2 | ADAMTS1 | 2639 | GGACAGTGCAAG CTCATCTG | 10 | ATCTACAACCTT GGGCTGCAA | 742 | CAAGCCAAAGGCATT GGCTACTTCTTCG | 1474 |
| ADAMTS2.1 | NM_014244 | NM_014244.1 | ADAMTS2 | 3979 | GAGAATGTCTGCC GCTGG | 11 | ATCGTGGTATTC ATCGTGGC | 743 | TACCTCCAGCAGAAG CCAGACACG | 1475 |
| ADAMTS4.1 | NM_005099 | NM_005099.3 | ADAMTS4 | 2642 | TTTGACAAGTGCAT GGTGTG | 12 | AATTTCCTGAAG GAGCCTGA | 744 | CTGCTTGTGCAACC AGAACCGT | 1476 |
| ADAMTS5.1 | NM_007038 | NM_007038.1 | ADAMTS5 | 2641 | CACTGTGGCTCAC GAAATCG | 13 | GGAACCAAAGGT CTCTTCACAGA | 745 | ATTTACTTGGCCTCT CCCATGACGATTCC | 1477 |
| ADAMTS8.1 | NM_007037 | NM_007037.2 | ADAMTS8 | 2640 | GCGAGTTCAAAGT GTTCGAG | 14 | CACAGATGGCCA GTGTTTCT | 746 | CACACAGGGTGCCA TCAATCACCT | 1478 |
| ADAMTS9.1 | NM_182920 | NM_182920.1 | ADAMTS9 | 6109 | GCACAGGTTACACA ACCCAA | 15 | CGACATTGGCAG TCATCG | 747 | CCCGGCTCCCGTTATA GGGACATTC | 1479 |
| ADD1.1 | NM_001119 | NM_001119.3 | ADD1 | 3980 | GTCTACCCAGCAG CTCCG | 16 | TCGTTCACAGGA GTCACCAT | 748 | CATGTTTAAGGCAGC CATCCCTCC | 1480 |

TABLE A-continued

| Gene | Accession Num | Sequence_ID | Official Symbol | Gene Version ID | F Primer Seq | SEQ ID NO. | R Primer Seq | SEQ ID NO. | Probe Seq | SEQ ID NO. |
|---|---|---|---|---|---|---|---|---|---|---|
| ADFP.1 | NM_001122 | NM_001122.2 | PLIN2 | 4503 | AAGACCATCACCTC CGTGG | 17 | CAATTTGCGGCT CTAGCTTC | 749 | ATGACCAGTGCTCTG CCCATCATC | 1481 |
| ADH1B.1 | NM_000668 | NM_000668.4 | ADH1B | 6325 | AAGCCAACAAACCT TCCTTC | 18 | AAAATGCAAGAA GTCACAGGAA | 750 | TTTCCTCAATGGCAA AGTGACACA | 1482 |
| ADH6.1 | NM_000672 | NM_000672.3 | ADH6 | 6111 | TGTTGGGAGTAAA CACTTGG | 19 | AACGATTCCAGC CCCTTC | 751 | TCTTGTATCCACCA TCTTGGGCC | 1483 |
| ADM.1 | NM_001124 | NM_001124.1 | ADM | 3248 | TAAGCCACAAGCAC ACGG | 20 | TGGGCGCCTAAA TCCTAA | 752 | CGAGTGGAAGTGCT CCCACTTTC | 1484 |
| AGR2.1 | NM_006408 | NM_006408.2 | AGR2 | 3245 | AGCCAACATGTGAC TAATTGGA | 21 | TCTGATCTCCAT CTGCCTCA | 753 | CAACACGTCACCACC CTTTGCTCT | 1485 |
| AGT.1 | NM_000029 | NM_000029.2 | AGT | 6112 | GATCCAGCCTCACT ATGCCT | 22 | CCAGTTGAGGGA GTTTTGCT | 754 | TGAGACCCTCCACCT TGTCCAGGT | 1486 |
| AGTR1.1 | NM_000685 | NM_000685.3 | AGTR1 | 4258 | AGCATTGATCGATA CCTGGC | 23 | CTACAAGCATTG TGCGTCG | 755 | ATTGTTCACCCAATG AAGTCCCGC | 1487 |
| AHR.1 | NM_001621 | NM_001621.2 | AHR | 3981 | GCGGCATAGAGAC CGACTT | 24 | ACATCTTGTGGG AAAGGCA | 756 | CAGGCTAGCCAAAC GGTCCAATC | 1488 |
| AIF1.1 | NM_032955 | NM_032955.1 | AIF1 | 6452 | GACGTTCAGCTACC CTGACTT | 25 | TCAGGATCATTT TTAGGATGGC | 757 | ATCTCTTGCCAGCA TCATCCTGA | 1489 |
| AKT1.3 | NM_005163 | NM_005163.1 | AKT1 | 18 | CGCTTCTATGGCG CTGAGAT | 26 | TCCCGGTACACC ACGTTCTT | 758 | CAGCCCTGACTAC CTGCACTCGG | 1490 |
| AKT2.3 | NM_001626 | NM_001626.2 | AKT2 | 358 | TCCTGCCACCCTTC AAACC | 27 | GGCGGTAAATTC ATCATCGAA | 759 | CAGTCACGTCCGA GGTCGACACA | 1491 |
| AKT3.2 | NM_005465 | NM_005465.1 | AKT3 | 21 | TTGTCTCTGCCTTG GACTATCTACA | 28 | CCAGCATTAGAT TCTCCACTTGA | 760 | TCACGGTACACAATC TTTCCGGA | 1492 |
| ALDH4A1.2 | NM_003748 | NM_003748.2 | ALDH4A1 | 2092 | GGACAGGGTAAGA CCGTGAT | 29 | AACCGGAAGAAG TCGATGAG | 761 | CTGCAGCGTCAATCT CCGCTTG | 1493 |
| ALDH6A1.1 | NM_005589 | NM_005589.2 | ALDH6A1 | 6114 | GGCTCTTTCAACAG CAGTCC | 30 | GCATGCTCCACC AGCTCT | 762 | CAGCCACTTCTTGGC TTCTCCAC | 1494 |
| ALDOA.1 | NM_000034 | NM_000034.2 | ALDOA | 3810 | GCCTGTACGTGCC AGCTC | 31 | TCATCGGAGCTT GATCTCG | 763 | TGCCAGAGCCTCAA CTGTCTCTGC | 1495 |
| ALDOB.1 | NM_000035 | NM_000035.2 | ALDOB | 6321 | CCCTCTACCAGAAG GACAGC | 32 | TAACTTGATTCC CACCACGA | 764 | TCCCCTTTTCCTTGA GGATGTTTCTG | 1496 |
| ALOX12.1 | NM_000697 | NM_000697.1 | ALOX12 | 3861 | AGTTCCTCAATGGT GCCAAC | 33 | AGCAGTAGCCTG GAGGGC | 765 | CATGCTGTTGAGAC GCTCGACCTC | 1497 |

TABLE A-continued

| Gene | Accession Num | Sequence_ID | Official Symbol | Gene Version ID | F Primer Seq | SEQ ID NO. | R Primer Seq | SEQ ID NO. | Probe Seq | SEQ ID NO. |
|---|---|---|---|---|---|---|---|---|---|---|
| ALOX5.1 | NM_000698 | NM_000698.2 | ALOX5 | 4259 | GAGCTGCAGGACT TCGTGA | 34 | GAAGCCTGAGGA CTTGCG | 766 | CCGCATGCCGTACA CGTAGACATC | 1498 |
| AMACR1.1 | NM_014324 | NM_014324.4 | AMACR | 3930 | GGACAGTCAGTTTT AGGGTTGC | 35 | GACAGCCCAGAG ACCCAC | 767 | CAGTAACTCGGGGC CTGTTTCCC | 1499 |
| ANGPT1.1 | NM_001146 | NM_001146.3 | ANGPT1 | 2654 | TCTACTTGGGGTGA CAGTGC | 36 | CCTTTTTAAAGC CCGACAGT | 768 | TCACGTGGCTCGAC TATAGAAACTCCA | 1500 |
| ANGPT2.1 | NM_001147 | NM_001147.1 | ANGPT2 | 2655 | CCGTGAAAGTGC TCTGTAA | 37 | TTGCAGTGGGAA GAACAGTG | 769 | AAGCTGACACAGCC CTCCCAAGTG | 1501 |
| ANGPTL2.1 | NM_012098 | NM_012098.2 | ANGPTL2 | 3982 | GCCATCTGCGTCAA CTCC | 38 | TAGCTCCTGCTT ATGCACTCG | 770 | TCTCCAGAAGCACCT CAGGCTCCT | 1502 |
| ANGPTL3.3 | NM_014495 | NM_014495.2 | ANGPTL3 | 6505 | GTTGCGATTACTGG CAATGT | 39 | TGCTTTGTGATC CCAAGTAGA | 771 | CCAATGCAATCCCG GAAAACAAAG | 1503 |
| ANGPTL4.1 | NM_016109 | NM_016109.2 | | 3237 | ATGACCTCAGATGG AGGCTG | 40 | CCGGTTGAAGTC CACTGAG | 772 | CATCGTGGCGCCTC TGAATTACTG | 1504 |
| ANGPTL7.1 | NM_021146 | NM_021146.2 | ANGPTL7 | 6115 | CTGCACAGACTCCA ACCTCA | 41 | GCCATCCAGGTG CTTATTGT | 773 | TCACCCAGGCGGTA GTACACTCCA | 1505 |
| ANTXR1.1 | NM_032208 | NM_032208.1 | ANTXR1 | 3363 | CTCCAGTGTGTACCT CCAACC | 42 | GAGAAGGCTGG GAGACTCTG | 774 | AGCCTTCTCCCACAG CTGCCTACA | 1506 |
| ANXA1.2 | NM_000700 | NM_000700.1 | ANXA1 | 1907 | GCCCCTATCCTACC TTCAATCC | 43 | CCTTTACCCATTA TGGCCTTATGC | 775 | TCCTCGGATGTCGCT GCCT | 1507 |
| ANXA2.2 | NM_004039 | NM_004039.1 | ANXA2 | 2269 | CAAGACACTAAGG GCGACTACCA | 44 | CGTGTCGGGCTT CAGTCAT | 776 | CCCACCACCAGGTAC AGCAGCCT | 1508 |
| ANXA4.1 | NM_001153 | NM_001153.2 | ANXA4 | 3984 | TGGGAGGGATGAA GGAAAT | 45 | CTCATACAGGTC CTGGGCA | 777 | TGTCTCACGAGAGCA TCGTCCAGA | 1509 |
| ANXA5.1 | NM_001154 | NM_001154.2 | ANXA5 | 3785 | GCTCAAGCCTGA AGATGAC | 46 | AGAACCACCAAC ATCCGCT | 778 | AGTACCCTGAAGTGT CCCCACCA | 1510 |
| AP-1 (JUN officia$$ | NM_002228 | NM_002228.2 | JUN | 2157 | GACTGCAAAGATG GAAACGA | 47 | TAGCCATAAGGT CCGCTCTC | 779 | CTATGACGATGCCCT CAACGCCTC | 1511 |
| AP1M2.1 | NM_005498 | NM_005498.3 | AP1M2 | 5104 | ACAACGACCGCAC CATCT | 48 | CTGAGGCGGTAT GACATGAG | 780 | CTTCATCCCGCCTGA TGGTGACTT | 1512 |
| APAF1.2 | NM_181861 | NM_181861.1 | APAF1 | 4086 | CACAAGGAAGAAG CTGGTGA | 49 | CATCCTGTTCA CCTTTCAA | 781 | TGCAATTCAGCAGAA GCTCCAAA | 1513 |
| APC.4 | NM_000038 | NM_000038.1 | APC | 41 | GGACAGCAGGAAT GTGTTTC | 50 | ACCCACTCGATT TGTTTCTG | 782 | CATTGGCTCCCCGT GACCTGTA | 1514 |

TABLE A-continued

| Gene | Accession Num | Sequence_ID | Official Symbol | Gene Version ID | F Primer Seq | SEQ ID NO. | R Primer Seq | SEQ ID NO. | Probe Seq | SEQ ID NO. |
|---|---|---|---|---|---|---|---|---|---|---|
| APOC1.3 | NM_001645 | NM_001645.3 | APOC1 | 6608 | CCAGCCTGAATAAAG GTCCTG | 51 | CACTCTGAATCC TTGCTGGA | 783 | AGGACAGGACCTCC CAACCAAGC | 1515 |
| APOE.1 | NM_000041 | NM_000041.2 | APOE | 4340 | GCCTCAAGAGCTG GTTCG | 52 | CCTGCACCTTCT CCACCA | 784 | ACTGGCGCTGCATG TCTTCCAC | 1516 |
| APOL1.1 | NM_003661 | NM_003661.2 | APOL1 | 6117 | CGGACCAAGAACT GTGACC | 53 | ATTTTGTCCTGG CCCCTG | 785 | AGGCATATCTCTCCT GGTGCTGC | 1517 |
| APOLD1.1 | NM_030817 | NM_030817.1 | APOLD1 | 6118 | GAGCAGCTGAGT CTCGG | 54 | AGAGATTTGAG GTCGTGGC | 786 | CAGTCTCGACCAA GTCCAGTCGT | 1518 |
| AQP1.1 | NM_198098 | NM_198098.1 | AQP1 | 5294 | GCTTGCTGTATGAC CCCTG | 55 | AAGGCTGACCTC TCCCCTC | 787 | ACAGCCTTCCCTG CAATTGACCT | 1519 |
| AREG.2 | NM_001657 | NM_001657.1 | AREG | 87 | TGTGAGTGAAATGC CTTCTAGTAGTGA | 56 | TTGTGGTTCGTT ATCATACTCTTCT | 788 | CCGTCCTCGGAGC CGACTATGA | 1520 |
| ARF1.1 | NM_001658 | NM_001658.2 | ARF1 | 2776 | CAGTAGAGATCCC CGCAACT | 57 | ACAAGCACATGG CTATGGAA | 789 | CTTGTCCTTGGGTCA CCCTGCA | 1521 |
| ARG99.1 | NM_031920 | NM_031920.2 | | 3873 | GCATGGGCTACTG CATCC | 58 | CCACATCGATTC AGCCAAG | 790 | AGTTGCTCAGTCC GTGCACAAAA | 1522 |
| ARGHEF18.1 | NM_015318 | NM_015318.2 | ARHGEF18 | 3008 | ACTCTGCTTCCCAA GGGC | 59 | GAAGCTAGAGGC CCGCTC | 791 | CTGTTCACACGCTCA GCCTGTCTG | 1523 |
| ARHA.1 | NM_001664 | NM_001664.1 | RHOA | 2981 | GGTCCTCCGTCGG TTCTC | 60 | GTCGCAAACTCG GAGACG | 792 | CCACGGTCTGGTCTT CAGTCACCC | 1524 |
| ARHGDIB.1 | NM_001175 | NM_001175.4 | ARHGDIB | 3987 | TGGTCCCTAGAACA AGAGGC | 61 | TGATGGAGGATC AGAGGGAG | 793 | TAAAACCGGGCTTTC ACCCAACCT | 1525 |
| ARRB1.1 | NM_004041 | NM_004041.2 | ARRB1 | 2656 | TGCAGGAACGCCT CATCAA | 62 | GGTTTGGAGGGA TCTCAAAGG | 794 | CTGGGCGAGCACGC TTACCCTTTC | 1526 |
| ASS1.1 | NM_054012 | NM_054012.3 | ASS1 | 6328 | CCCCAGATAAAG GTCATTG | 63 | TGCGTACTCCAT CAGTCAT | 795 | TCTACAACCGGTTCA AGGGCCG | 1527 |
| ATP1A1.1 | NM_000701 | NM_000701.6 | ATP1A1 | 6119 | AGAACGCCCTATTTG GAGCTG | 64 | GGCAGAAAGAGG TGGCAG | 796 | ACCTAGGACTCGTTC TCCGAGGC | 1528 |
| ATP5E.1 | NM_006886 | NM_006886.2 | ATP5E | 3535 | CCGCTTTTCGCTACA GCAT | 65 | TGGGAGTATCGG ATGTAGCTG | 797 | TCCAGCCTGTCTCCA GTAGCCAC | 1529 |
| ATP6V1B1.1 | NM_001692 | NM_001692.3 | ATP6V1B1 | 6293 | AACCATGGGGAAC GTCTG | 66 | GGTGATGATCCG CTCGAT | 798 | CTTCCTGAACTTGGC CAATGACCC | 1530 |
| AXL.1 | NM_001699 | NM_001699.3 | AXL | 3989 | TTGCAGCCCTGTCT TCCTAC | 67 | CTGCACAGAGAA GGGGAGG | 799 | TATCCCACCTCCATC CCAGACAGG | 1531 |

TABLE A-continued

| Gene | Accession Num | Sequence_ID | Official Symbol | Gene Version ID | F Primer Seq | SEQ ID NO. | R Primer Seq | SEQ ID NO. | Probe Seq | SEQ ID NO. |
|---|---|---|---|---|---|---|---|---|---|---|
| AZU1.1 | NM_001700 | NM_001700.3 | AZU1 | 6120 | CCGAGGCCCTGACTTCTT | 68 | GTCCCGGGTTGTTGAGAA | 800 | CCATCGATCCAGTCTCGGAAGAGC | 1532 |
| B-Catenin.3 | NM_001904 | NM_001904.1 | CTNNB1 | 769 | GGCTCTTGTGCGTACTGTCCTT | 69 | TCAGATGACGAAGAGCACAGATG | 801 | AGGCTCAGTGATGTCTTCCCTGTCACCAG | 1533 |
| B2M.4 | NM_004048 | NM_004048.1 | B2M | 467 | GGGATCGAGACATGTAAGCA | 70 | TGGAATTCATCCAATCCAAAT | 802 | CGGCATCTTCAAACCTCCATGATG | 1534 |
| BAD.1 | NM_032989 | NM_032989.2 | BAD | 7209 | GGGTCAGGGGCCTCGAGAT | 71 | CTGCTCACTCGGCTCAAACTC | 803 | TGGGCCCAGAGCATGTTCCAGATC | 1535 |
| BAG1.2 | NM_004323 | NM_004323.2 | BAG1 | 478 | CGTTGTCAGCACACTTGGAATACAA | 72 | GTTCAACCTCTTCCTGTGGACTGT | 804 | CCCAATTAACATGACCCGGCAACCAT | 1536 |
| BAG2.1 | NM_004282 | NM_004282.2 | BAG2 | 2808 | CTAGGGGCAAAAAGCATGA | 73 | CTAAATGCCAAGGTGACTG | 805 | TTCCATGCCAGACAGGAAAAAGCA | 1537 |
| Bak.2 | NM_001188 | NM_001188.1 | BAK1 | 82 | CCATTCCCACCATTCTACCT | 74 | GGGAACATAGACCCACCAAT | 806 | ACACCCCAGACGTCCTGGCCT | 1538 |
| Bax.1 | NM_004324 | NM_004324.1 | BAX | 10 | CCGCCGTGGACACAGACT | 75 | TTGCCGTCAGAAAACATGTCA | 807 | TGCCACTCGGAAAAAGACCTCTGG | 1539 |
| BBC3.2 | NM_014417 | NM_014417.1 | BBC3 | 574 | CCTGGAGGGTCCTGTACAAT | 76 | CTAATTGGGCTCCATCTCG | 808 | CATCATGGGACTCCTGCCCTTACC | 1540 |
| Bcl2.2 | NM_000633 | NM_000633.1 | BCL2 | 61 | CAGATGACCTTGAGTACCCACTGAGA | 77 | CCTATGATTAAGGGCATTTTTCC | 809 | TTCCACGCCGAAGGACAGCGAT | 1541 |
| BCL2A1.1 | NM_004049 | NM_004049.2 | BCL2A1 | 6322 | CCAGCCTCCATGTATCATCA | 78 | TGAAGCTGTTGAGGCAATGT | 810 | CAGTCAAGCTCAGTGAGCATTCTCAGC | 1542 |
| BCL2L12.1 | NM_138639 | NM_138639.1 | BCL2L12 | 3364 | AACCCACCCCTGTCTTGG | 79 | CTCAGCTGACGGGAAAGG | 811 | TCCGGTAGCTCTCAAACTCGAGG | 1543 |
| Bclx.2 | NM_001191 | NM_001191.1 | BCL2L1 | 83 | CTTTTGTGGAACTCTATGGGAACA | 80 | CAGCGGTTGAAGCGTTCCT | 812 | TTCGGCTCTCGGCTGCTGCA | 1544 |
| BCRP.1 | NM_004827 | NM_004827.1 | ABCG2 | 364 | TGTACTGGCAAGAATATTTGGTAAA | 81 | GCCACGTGATTCTTCCACAA | 813 | CAGGGCATCGATCTCTCACCCTGG | 1545 |
| BFGF.3 | NM_007083 | NM_007083.1 | NUDT6 | 345 | CCAGGAAGAATGCTTAAGATGTGA | 82 | TGGTGATGGGAGTTGTATTTTCAG | 814 | TTCCGCCAGTCATTGAGATCCATCCA | 1546 |
| BGN.1 | NM_001711 | NM_001711.3 | BGN | 3391 | GAGCTCCGCAAGGATGAC | 83 | CTTTGTTGTTCACCAGGACGA | 815 | CAAGGGTCTCCAGCACCTCTACG | 1547 |
| BHLHB3.1 | NM_030762 | NM_030762.1 | BHLHE41 | 6121 | AGGAAGATCCCTCGCAGC | 84 | TTGAACCTCCGTCCTTCG | 816 | AGGAAGCTCCCTGAATCCTTGCGT | 1548 |

TABLE A-continued

| Gene | Accession Num | Sequence_ID | Official Symbol | Gene Version ID | F Primer Seq | SEQ ID NO. | R Primer Seq | SEQ ID NO. | Probe Seq | SEQ ID NO. |
|---|---|---|---|---|---|---|---|---|---|---|
| BIK.1 | NM_001197 | NM_001197.3 | BIK | 2281 | ATTCCTATGGCTCTGCAATTGTC | 85 | GGCAGGAGTGAATGGCTCTC | 817 | CCGTTAACTGTGGCCTGTGCCC | 1549 |
| BIN1.3 | NM_004305 | NM_004305.1 | BIN1 | 941 | CCTGCAAAAGGAACAAGAG | 86 | CGTGGTTGACTCTGATCTCG | 818 | CTTCGCCTCCAGATGGCTCCC | 1550 |
| BLR1.1 | NM_001716 | NM_001716.3 | CXCR5 | 6280 | GACCAAGCAGGAAGCTCAGA | 87 | AGCGCTGTTTCGGTCACTCAA | 819 | CCAGGGGCAGCTACCTGAACTCAA | 1551 |
| BNIP3.1 | NM_004052 | NM_004052.2 | BNIP3 | 3937 | CTGGACGGAGTAGCTCCAAG | 88 | GGTATCTTGTGGTGTCTGCG | 820 | CTTCACTGTGACAGCCCACCTCG | 1552 |
| BRCA1.1 | NM_007294 | NM_007294.3 | BRCA1 | 7481 | TCAGGGGCTAGAAATCTGT | 89 | CCATTCCAGTTGATCTGTGG | 821 | CTATGGGCCCTTCACCAACATGC | 1553 |
| BTRC.1 | NM_033637 | NM_033637.2 | BTRC | 2555 | GTTGGGACACAGTTGGTCTG | 90 | TGAAGCAGTCAGTTGTGCTG | 822 | CAGTCGGCGCCAGGACGGTCTACT | 1554 |
| BUB1.1 | NM_004336 | NM_004336.1 | BUB1 | 1647 | CCGAGGTTAATCCAGCACGTA | 91 | AAGACATGGCGCTCTCAGTTC | 823 | TGCTGGGAGCCTACACTTGGCCC | 1555 |
| BUB3.1 | NM_004725 | NM_004725.1 | BUB3 | 3016 | CTGAAGCAGATGGTTCATCATT | 92 | GCTGATTCCCAAGAGTCTAACC | 824 | CCTCGCTTTGTTTAACAGCCCAGG | 1556 |
| c-kit.2 | NM_000222 | NM_000222.1 | KIT | 50 | GAGGCAACTGCTTATGGCTTAATTA | 93 | GGCACTCGGCTTGAGCAT | 825 | TTACAGCGACAGTCATGGCCGCAT | 1557 |
| C13orf15.1 | NM_014059 | NM_014059.2 | C13orf15 | 6122 | TAGAATCTGCTGCCAGAGGG | 94 | CAAGGGCTGATTTTAAGGTGA | 826 | TGCACTCAACCTTCTACCAGGCCA | 1558 |
| C1QA.1 | NM_015991 | NM_015991.2 | C1QA | 6123 | CGGTCATCACCAACCAGG | 95 | CGGGTACAGTGCAGACGA | 827 | AGAACCGTACCAGAACCACTCCGG | 1559 |
| C1QB.1 | NM_000491 | NM_000491.3 | C1QB | 6124 | CCAGTGGCCTCACAGGAC | 96 | CCCATGGGATCTTCATCATC | 828 | TCCCAGGAGGCGTCTGACACAGTA | 1560 |
| C20orf1.1 | NM_012112 | NM_012112.2 | TPX2 | 1239 | TCAGCTGTGAGCTGCGGATA | 97 | ACGGTCCTAGTTTGAGGTTAAGA | 829 | CAGTCCCATTGCCGGGCG | 1561 |
| C3.1 | NM_000064 | NM_000064.2 | C3 | 6125 | CGTGAAGGAGTGCAGAAAGA | 98 | ACTCGGTGTCCGGGACTT | 830 | ACATCCCACCTGCAGACCTCAGTG | 1562 |
| C3AR1.1 | NM_004054 | NM_004054.2 | C3AR1 | 6126 | AAGCCGCATCCCAGACTT | 99 | TGTTAAGTGCCCTTGCTGG | 831 | CAACCCCAGAGATTCCGATTCAG | 1563 |
| C7.1 | NM_000587 | NM_000587.2 | C7 | 6127 | ATGTCTGAGTGTGAGGCGG | 100 | AGGCCTTATGCTGGTGACAG | 832 | ATGTCTGCCCTCTGCATCTCAGA | 1564 |
| CA12.1 | NM_001218 | NM_001218.3 | CA12 | 6128 | CTCTCTGAAGTGTCCTGGC | 101 | ACAGGACTGAGGGTGCT | 833 | AGACCACCAGTGCTTCTCCAGGGCT | 1565 |

TABLE A-continued

| Gene | Accession Num | Sequence_ID | Official Symbol | Gene Version ID | F Primer Seq | SEQ ID NO. | R Primer Seq | SEQ ID NO. | Probe Seq | SEQ ID NO. |
|---|---|---|---|---|---|---|---|---|---|---|
| CA2.1 | NM_000067 | NM_000067.1 | CA2 | 5189 | CAACGTGGAGTTTGATGACTCT | 101 | CTGTAAGTGCCATCCAGGG | 834 | CCTCCCTTGAGCACTGCTTTGTCC | 1566 |
| CA9.3 | NM_001216 | NM_001216.1 | CA9 | 482 | ATCCTAGCCCTGGTTTTGG | 102 | CTGCCTTCATCTGCACAA | 835 | TTTGCTGTCACCAGCGTCGC | 1567 |
| CACNA2D1.1 | NM_000722 | NM_000722.2 | CACNA2D1 | 6129 | CAAACATTAGCTGGGCCTGT | 103 | CAGCCAGTGGGTGCCTTA | 836 | CCATGGCATAACACTAAGGCGCAG | 1568 |
| CALD1.2 | NM_004342 | NM_004342.4 | CALD1 | 1795 | CACTAAGGTTTGAGACAGTTCCAGAA | 104 | GCGAATTAGCCCTCTACAACTGA | 837 | AACCCAAGCTCAAGACGCAGGACGAG | 1569 |
| CASP1.1 | NM_033292 | NM_033292.2 | CASP1 | 6132 | AGAAAGCCCACATAGAGAGGA | 105 | TGTGGGATGTCTCCAAGAAA | 838 | CGCTTTCTGCTCTTCCACACCAGA | 1570 |
| CASP10.1 | NM_001230 | NM_001230.4 | CASP10 | 6133 | ACCTTTCTCTCTTGGCCGGAT | 106 | GTGGGGACTGTCCACTGC | 839 | TCTACTGCATCTGCCAGCCCTGAG | 1571 |
| CASP6.1 | NM_032992 | NM_032992.2 | CASP6 | 6134 | CCTCACACTGGTGAACAGGA | 107 | AATTGCACTTGGGTCTTTGC | 840 | AAAGTCCACTCGGCGCTGAGAAAC | 1572 |
| Caspase 3.1 | NM_032991 | NM_032991.2 | CASP3 | 5963 | TGAGCTGAGCAGAGACATGA | 108 | CCTTCCTGCGTGGTCCAT | 841 | TCAGCCTCTTCCATGAAGCAGAGC | 1573 |
| CAT.1 | NM_001752 | NM_001752.1 | CAT | 2745 | ATCCATTGCGATCTCACCAAGGT | 109 | TCCGGTTTAAGACCAGTTTACCA | 842 | TGGCCTCACAAGGACTACCCTCTCATCC | 1574 |
| CAV1.1 | NM_001753 | NM_001753.3 | CAV1 | 2557 | GTGGCTCAACATTGTGTTCC | 110 | CAATGGGCCTCCATTTTACAG | 843 | ATTTCAGCTGATCAGTGGGCTCC | 1575 |
| CAV2.1 | NM_198212 | NM_198212.1 | CAV2 | 6460 | CTTCCCTGGGACGACTTG | 111 | TTCCTGGTCACCCTTCTGG | 844 | CCCGTACTGTCATGCCTCAGAGCT | 1576 |
| CCL18.1 | NM_002988 | NM_002988.2 | CCL18 | 3994 | GCTCCTGTGCACAAGTTGG | 112 | TGGAATCTGCCAGGAGGTA | 845 | CAACAAAGAGCTCTGCTGCCTCGT | 1577 |
| CCL19.1 | NM_006274 | NM_006274.2 | CCL19 | 4107 | GAACGCATCATCCAGAGACTG | 113 | CCTCTGCACGGTCATAGGTT | 846 | CGCTTCATCTTGGCTGAGGCCTC | 1578 |
| CCL20.1 | NM_004591 | NM_004591.1 | CCL20 | 1998 | CCATGTGCTGTACCAAGAGTTTG | 114 | CGCCGCGAGGTGGAGTA | 847 | CAGCACTGACATCAAAGCACCAGGA | 1579 |
| CCL4.2 | NM_002984 | NM_002984.1 | CCL4 | 4148 | GGGTCCAGGAGTACGTGTATGAC | 115 | CCTTCCCTGAAGACTTCCTGTCT | 848 | ACTGAACTGAGCTGCTCA | 1580 |
| CCL5.2 | NM_002985 | NM_002985.2 | CCL5 | 4088 | AGGTTCTGAGCTCTGGCTTT | 116 | ATGCTGACTTCCTTCCTGGT | 849 | ACAGAGCCCTGGCAAAGCCAAG | 1581 |
| CCNB1.2 | NM_031966 | NM_031966.1 | CCNB1 | 619 | TTCAGGTTGTTGCAGGAGAC | 117 | CATCTTCTTGGGCACACAAT | 850 | TGTCTCCATTATTGATCGGTTCATGCA | 1582 |

TABLE A-continued

| Gene | Accession Num | Sequence_ID | Official Symbol | Gene Version ID | F Primer Seq | SEQ ID NO. | R Primer Seq | SEQ ID NO. | Probe Seq | SEQ ID NO. |
|---|---|---|---|---|---|---|---|---|---|---|
| CCND1.3 | NM_053056 | NM_001758.1 | CCND1 | 88 | GCATGTTCGTGGC CTCTAAGA | 119 | CGGTGTAGATGC ACAGCTTCTC | 851 | AAGAGACCATCCC CCTGACGGC | 1583 |
| CCNE1.1 | NM_001238 | NM_001238.1 | CCNE1 | 498 | AAAGAAGATGATGA CCGGGTTTAC | 120 | GAGCCTCTGGAT GGTGCAAT | 852 | CAAACTCAACGTGCA AGCCTCGA | 1584 |
| CCNE2 variant 1 | NM_057749 | NM_057749var1 | CCNE2 | 1650 | GGTCACCAAGAAAC ATCAGTATGAA | 121 | TTCAATGATAATG CAAGGACTGATC | 853 | CCCAGATAATACAGG TGGCCAACATTCCT | 1585 |
| CCNE2.2 | NM_057749 | NM_057749.1 | CCNE2 | 502 | ATGCTGTGGCTCCT TCCTAACT | 122 | ACCCAAATTGTG ATATACAAAAAG GTT | 854 | TACCAAGCAACCTAC ATGTCAAGAAGCCC | 1586 |
| CCR1.1 | NM_001295 | NM_001295.2 | CCR1 | 6135 | TCCAAGACCCAATG GGAA | 123 | TCGTAGGCTTTC GTGAGGA | 855 | ACTTCACCACCTGC AGCCTTCAC | 1587 |
| CCR2.1 | NM_000648 | NM_000648.1 | | 4109 | CTCGGGAATCCTG AAAACC | 124 | GACTCTCACTGC CCTATGCC | 856 | TCTTCTCGTTTCGAC ACCGAAGCA | 1588 |
| CCR4.2 | NM_005508 | NM_005508.4 | CCR4 | 6502 | AGACCCTGGTGGA GCTAGAA | 125 | AGAGTTCTGTG GCCTGGAT | 857 | TCCTTCAGGACTGCA CCTTTGAAAGA | 1589 |
| CCR5.1 | NM_000579 | NM_000579.1 | CCR5 | 4119 | CAGACTGAATGGG GGTGG | 126 | CTGGTTTGTCTG GAGAAGGC | 858 | TGGAATAAGTACCTA AGGCGCCCC | 1590 |
| CCR7.1 | NM_001838 | NM_001838.2 | CCR7 | 2661 | GGATGACATGCACT CAGCTC | 127 | CCTGACATTTCC CTTGTCCT | 859 | CTCCCATCCCAGTG GAGCCAA | 1591 |
| CD105.1 | NM_000118 | NM_000118.1 | ENG | 486 | GCAGGTGTCAGCA AGTATGATCAG | 128 | TTTTTCCCTGT GGTGATGA | 860 | CGACAGGATATTGAC CACCGCCTCATT | 1592 |
| CD14.1 | NM_000591 | NM_000591.1 | CD14 | 4341 | GTGTGCTAGCGTA CTCCCG | 129 | GCATGGTGCCG GTTATCT | 861 | CAAGGAACTGACGC TCGAGGACCT | 1593 |
| CD18.2 | NM_000211 | NM_000211.1 | ITGB2 | 49 | CGTCAGGACCCAC CATGTCT | 130 | GGTTAATTGGTG ACATCCTCAAGA | 862 | CGCGGCCGAGACAT GGCTTG | 1594 |
| CD1A.1 | NM_001763 | NM_001763.1 | CD1A | 4166 | GGAGTGGAAGGAA CTGGAAA | 131 | TCATGGGCGTAT CTACGAAT | 863 | CGCACCATTCGGTCA TTTGAGG | 1595 |
| CD24.1 | NM_013230 | NM_013230.1 | CD24 | 2364 | TCCAACTAATGCCA CCACCA | 132 | GAGAGAGTGAGA CCACGAAGAGACT | 864 | CTGTTGACTGCAGG GCACCACA | 1596 |
| CD274.2 | NM_014143 | NM_014143.2 | CD274 | 4076 | GCTCATGATCAG CTATGGT | 133 | TGTTGTATGGGG CATTGACT | 865 | CACAGTAATTCGCTT GTAGTCGGCACC | 1597 |
| CD31.3 | NM_000442 | NM_000442.1 | PECAM1 | 485 | TGTATTTCAAGACC TCTGTGCACTT | 134 | TTAGCCTGAGGA ATTGCTGTGTT | 866 | TTTATGAACCTGCCC TGCTCCCACA | 1598 |

TABLE A-continued

| Gene | Accession Num | Sequence_ID | Official Symbol | Gene Version ID | F Primer Seq | SEQ ID NO. | R Primer Seq | SEQ ID NO. | Probe Seq | SEQ ID NO. |
|---|---|---|---|---|---|---|---|---|---|---|
| CD34.1 | NM_001773 | NM_001773.1 | CD34 | 3814 | CCACTGCACACCTCAGA | 135 | CAGGAGTTTACCTGCCCT | 867 | CTGTTCTTGGGGCCCTACACCTTG | 1599 |
| CD36.1 | NM_000072 | NM_000072.2 | CD36 | 6138 | GTAACCCAGGACGCTGAGG | 136 | AAGGTTCGAAGATGGCACC | 868 | CACAGTCTCTTTCCTGCAGCCCAA | 1600 |
| CD3z.1 | NM_000734 | NM_000734.1 | CD247 | 64 | AGATGAAGTGGAAGGCGCTT | 137 | TGCCTCTGTAATCGGCAACTG | 869 | CACCGCGGCCATCCTGCA | 1601 |
| CD4.1 | NM_000616 | NM_000616.2 | CD4 | 4168 | GTGCTGGAGTCGGGACTAAC | 138 | TCCCTGCATTCAAGAGGC | 870 | CAGGTCCCTTGTCCCAAGTTCCAC | 1602 |
| CD44.1 | NM_000610 | NM_000610.3 | CD44 | 4267 | GGCACCACTGCTTATGAAGG | 139 | GATGCTCATGGTGAATGAGG | 871 | ACTCGAACCCAGAGCACCCTC | 1603 |
| CD44s.1 | M59040 | M59040.1 | | 1090 | GACGAGACAGTCCCTGGAT | 140 | ACTGGGGTGGAATGTGTCTT | 872 | CACCGACAGCACAGACAGAATCCC | 1604 |
| CD44v6.1 | AJ251595v6 | AJ251595v6 | | 1061 | CTCATACCAGCCATCCAATG | 141 | TTGGGTTGAAGAAATCAGTCC | 873 | CACCAAGCCCAGAGGACAGTTCCT | 1605 |
| CD53.1 | NM_000560 | NM_000560.3 | CD53 | 6139 | CGACAGCATCCACCGTTAC | 142 | TGCAGAAATGACTGGATGGA | 874 | CACGCTGCCTTGGTGCTATTGTCT | 1606 |
| CD68.2 | NM_001251 | NM_001251.1 | CD68 | 84 | TGGTTCCCAGCCCTGTGT | 143 | CTCCTCCACCCTGGGTTGT | 875 | CTCCAAGCCCAGATTCAGATTCGAGTCA | 1607 |
| CD82.2 | NM_002231 | NM_002231.2 | CD82 | 316 | GTGCAGGCTCAGGTGAAGTG | 144 | GACCTCCAGGGCGATTCATGA | 876 | TCAGCTTCTACAACTGGACAGACAACGCTG | 1608 |
| CD8A.1 | NM_171827 | NM_171827.1 | CD8A | 3804 | AGGGTGAGGTGCTTGAGTCT | 145 | GGGCACAGTATCCCAGGTA | 877 | CCAACGGCAAGGAACAAGTACTTCT | 1609 |
| CD99.1 | NM_002414 | NM_002414.3 | CD99 | 6323 | GTTCCTCCGGTAGCTTTTCA | 146 | ACCATCACTGCCTCCTTTTC | 878 | TCCACCTGAAACGCCATCCG | 1610 |
| cdc25A.4 | NM_001789 | NM_001789.1 | CDC25A | 90 | TCTTGCTGGCTACGCCTCTT | 147 | CTGCATTGTGGCACAGTTCTG | 879 | TGTCCCTGTTAGACGTCCTCCGTCCATA | 1611 |
| CDC25B.1 | NM_021873 | NM_021874.1 | CDC25B | 389 | AAACAGACAGTTTGCCATCAG | 148 | GTTGGTGATGTTCCGAAGCA | 880 | CCTTCACCGGCATAGACTGGAAGCG | 1612 |
| CDH1.3 | NM_004360 | NM_004360.2 | CDH1 | 11 | TGAGTGTCCCCGGTATCTTC | 149 | CAGCCGCTTTCAGATTTTCAT | 881 | TGCCAATCCCGATGAAATTGGAAATTT | 1613 |
| CDH13.1 | NM_001257 | NM_001257.3 | CDH13 | 6140 | GCTACTTCTCCACTGTCCCG | 150 | CCTCTCTGTGGACCTGCCT | 882 | AGTCTGAATGCTGCCACAACCAGC | 1614 |
| CDH16.1 | NM_004062 | NM_004062.2 | CDH16 | 4529 | GACTGTCTCGAATGGCCCAG | 151 | CCAGGGGACTCAGATGGA | 883 | CAGAGGCCAAGCTCCCAGCTAGAG | 1615 |

TABLE A-continued

| Gene | Accession Num | Sequence_ID | Official Symbol | Gene Version ID | F Primer Seq | SEQ ID NO. | R Primer Seq | SEQ ID NO. | Probe Seq | SEQ ID NO. |
|---|---|---|---|---|---|---|---|---|---|---|
| CDH2.1 | NM_001792 | NM_001792.2 | CDH2 | 3965 | TGACCGATAAGGATCAACCC | 152 | GATCTCCGCCACTGATTCTG | 884 | ATACACCAGCCTGAACGCAGTGT | 1616 |
| CDH5.1 | NM_001795 | NM_001795.2 | CDH5 | 6142 | ACAGGAGACGTGTTCGCC | 153 | CAGCAGTGAGGTGGTACTCTGA | 885 | TATTCTCCGGTCCAGCCTCTCAA | 1617 |
| CDH6.1 | NM_004932 | NM_004932.2 | CDH6 | 3998 | ACACAGGCGACATACAGGC | 154 | CTCGAAGGATGTAAACGGGT | 886 | TTTCTTCCCTGTCCAGCCTCTTGG | 1618 |
| CDK4.1 | NM_000075 | NM_000075.2 | CDK4 | 4176 | CCTTCCCATCAGCACAGTTC | 155 | TTGGGATGCTCAAAAGCC | 887 | CCAGTCGCCTCAGTAAAGCCACCT | 1619 |
| CDK6.1 | NM_001259 | NM_001259.5 | CDK6 | 6143 | AGTGCCCTGTCTCACCCA | 156 | GCAGGTGGGAATCCAGGT | 888 | TCTTTGCACCTTTCCAGGTCCTGG | 1620 |
| CDKN2A.2 | NM_000077 | NM_000077.3 | CDKN2A | 4278 | AGCACTTCACGCCCTAAGC | 157 | TCATGAGTCGACAGCTTCC | 889 | CGCAAGAAATGCCCACATGAATGT | 1621 |
| CEACAM1.1 | NM_001712 | NM_001712.2 | CEACAM1 | 2577 | ACTTGCCTGTTCAGAGCACTCA | 158 | TGGCAAATCCGAATTAGAGTGA | 890 | TCCTTCCACCCCCAGTCCTGTC | 1622 |
| CEBPA.1 | NM_004364 | NM_004364.2 | CEBPA | 2961 | TTGGTTTTGCTCGGATACTTG | 159 | GTCTCAGACCCTTCCCCC | 891 | AAAATGAGACTCTCCGTCGGCAGC | 1623 |
| CENPF.1 | NM_016343 | NM_016343.2 | CENPF | 3251 | CTCCCGTCAACAGCGTTC | 160 | GGGTGAGTCTGGCCTTCA | 892 | ACACTGGACCAGGAGTGCATCCAG | 1624 |
| CFLAR.1 | NM_003879 | NM_003879.3 | CFLAR | 6144 | GGACTTTTGTGTCCAGTGACAG | 161 | CGGCGCTTCTCTCCTACA | 893 | CTCCTCCCGTGGTCCTTGTGTCT | 1625 |
| CGA (CHGA offi$$ | NM_001275 | NM_001275.2 | CHGA | 1132 | CTGAAGGAGCTCCAAGACCT | 162 | CAAAACCGCTGTGTTTCTTC | 894 | TGTTGATGTGCCCTCTCCTTGG | 1626 |
| Chk1.2 | NM_001274 | NM_001274.1 | CHEK1 | 490 | GATAAATTGGTACAAGGGATCAGCTT | 163 | GGGTGCCAAGTAACTGACTATTCA | 895 | CCAGCCCACATGTCCTGATCATATGC | 1627 |
| Chk2.3 | NM_007194 | NM_007194.1 | CHEK2 | 494 | ATGTGAACCCCCACCTACTT | 164 | CAGTCCACAGCACGGTTATACC | 896 | AGTCCAACAGAGAAACAAGAACTTCAGGCG | 1628 |
| cIAP1.2 | NM_001166 | NM_001166.2 | BIRC2 | 326 | TGCCTGTGGTGGGAAGCT | 165 | GGAAAAATGCCTCCGGTGTT | 897 | TGACATAGCATCATCCTTTGGTTCCCAGTT | 1629 |
| cIAP2.2 | NM_001165 | NM_001165.2 | BIRC3 | 79 | GGATATTTCCGTGGCTCTTATTCA | 166 | CTTCCATCATCAAGGCAGAAAATCTT | 898 | TCTCCATCAAATCCTGTAAACTCCAGAGCA | 1630 |
| CLCNKB.1 | NM_000085 | NM_000085.1 | CLCNKB | 4308 | GTGACCCTGAAGCTGTCCC | 167 | GGTTCAACAGCTCAAAGAGGTT | 899 | AGAGACTTCCCTGCATGAGGCACA | 1631 |
| CLDN10.1 | NM_182848 | NM_182848.2 | CLDN10 | 6145 | GGTCTGTGGATGAACTGCG | 168 | GATAGTAAAATGCGTCGGC | 900 | TGGAAAGAACCCAACGCGTTACCT | 1632 |

TABLE A-continued

| Gene | Accession Num | Sequence_ID | Official Symbol | Gene Version ID | F Primer Seq | SEQ ID NO. | R Primer Seq | SEQ ID NO. | Probe Seq | SEQ ID NO. |
|---|---|---|---|---|---|---|---|---|---|---|
| CLDN7.2 | NM_001307 | NM_001307.3 | CLDN7 | 2287 | GGTCTGCCCTAGTCATCCTG | 169 | GTACCCAGCCTTGCTCTCAT | 901 | TGCACTGCTCTCCTGTTCCTGTCC | 1633 |
| CLU.3 | NM_001831 | NM_001831.1 | CLU | 2047 | CCCCAGATACCTACCACTACCT | 170 | TGCGGGACTTGGGAAAGA | 902 | CCCTTCAGCCTGCCCCACCG | 1634 |
| cMet.2 | NM_000245 | NM_000245.1 | MET | 52 | GACATTTCCAGTCCTGCAGTCA | 171 | CTCCGATCGCACACATTTGT | 903 | TGCCTCTCTGCCCCACCCTTTGT | 1635 |
| cMYC.3 | NM_002467 | NM_002467.1 | MYC | 45 | TCCCTCCACTCGGAAGGACTA | 172 | CGGTTGTTGCTGATCTGTCTCA | 904 | TCTGACACTGTCAACTTGACCCTCTT | 1636 |
| COL18A1.1 | NM_030582 | NM_030582.3 | COL18A1 | 6146 | AGCTGCCATCACGCCTAC | 173 | GTTGGCTACTTGGAGGCAGTC | 905 | CGTGCTCTGCATTGAGAACAGCTTC | 1637 |
| COL1A1.1 | NM_000088 | NM_000088.2 | COL1A1 | 1726 | GTGGCCATCCAGCTGACC | 174 | CAGTGGTAGGTGATGTTCTGGGA | 906 | TCCTGCGCTGATGTCCACCG | 1638 |
| COL1A2.1 | NM_000089 | NM_000089.2 | COL1A2 | 1727 | CAGCCAAGAACTGGTATAGGAGCT | 175 | AAACTGCTGCCAGCATTG | 907 | TCTCCTAGCCAGACGTGTTTCTTGTCCTTG | 1639 |
| COL4A1.1 | NM_001845 | NM_001845.4 | COL4A1 | 6147 | ACAAAGGCCTCCCAGGAT | 176 | GAGTCCCAGGAAGACCTGCT | 908 | CTCCTTTGACACCAGGGATGCCAT | 1640 |
| COL4A2.1 | NM_001846 | NM_001846.2 | COL4A2 | 6148 | CAACCCTGGTGATGTCTGC | 177 | CGCAGTGTGTAGAGAGCCAGT | 909 | ACTATGCCAGCCGGAACGACAAGT | 1641 |
| COL5A2.2 | NM_000393 | NM_000393.3 | COL5A2 | 6653 | GGTCGAGGAACCCAAGGT | 178 | GCCTGGGAGGTCCAACTCTG | 910 | CCAGGAAATCCTGTAGCACCAGGC | 1642 |
| COL7A1.1 | NM_000094 | NM_000094.2 | COL7A1 | 4984 | GGTGACAAAGGACCTCGG | 179 | ACCAGGCTCTCCCTTGCT | 911 | CTTGTCACCAGGGTCCCATTGTC | 1643 |
| COX2.1 | NM_000963 | NM_000963.1 | PTGS2 | 71 | TCTGCAGAGTTGGAAGCACTCTA | 180 | GCCGAGGCTTTTCTACCAGAA | 912 | CAGGATACAGCTCCACAGCATCGATGTC | 1644 |
| CP.1 | NM_000096 | NM_000096.1 | CP | 3244 | CGTGAGTACACAGATGCCT | 181 | CCAGGATGCCAAGATGCT | 913 | TCTTCAGGGCCTCTCTCCTTTCGA | 1645 |
| CPB2.1 | NM_001872 | NM_001872.3 | CPB2 | 6294 | GGCACATACGGATTCTTGCT | 182 | CAGCGGCAAAAGCTTCTCTA | 914 | CGGAGCGTTACATCAAACCCACCT | 1646 |
| CRADD.1 | NM_003805 | NM_003805.3 | CRADD | 6149 | GATGTGCCTCCAGCAAC | 183 | GAGTGAAAGTCAGGATTCAGCC | 915 | CATGACTCAGGGACACACTCCCCA | 1647 |
| cripto (TDGF1 of | NM_003212 | NM_003212.1 | TDGF1 | 1096 | GGGTCTGTGCCCCATGAC | 184 | TGACCGTGCCAGCATTTACA | 916 | CCTGGCTGCCAAGAAGTGTTCCCT | 1648 |
| CRP.1 | NM_000567 | NM_000567.2 | CRP | 4187 | GACGTGAACCACAGGGTGT | 185 | CTCCAGATAGGGAGTGTGGG | 917 | CTGTCAGGAGGAGCCCATCTCCCAT | 1649 |

TABLE A-continued

| Gene | Accession Num | Sequence_ID | Official Symbol | Gene Version ID | F Primer Seq | SEQ ID NO. | R Primer Seq | SEQ ID NO. | Probe Seq | SEQ ID NO. |
|---|---|---|---|---|---|---|---|---|---|---|
| CSF1.1 | NM_000757 | NM_000757.3 | CSF1 | 510 | TGCAGCGGCTGATTGACA | 186 | CAACTGTTCCTGGTCTACAAACTCA | 918 | TCAGATGAGACCTCGTGCCAAATTACA | 1650 |
| CSF1R.2 | NM_005211 | NM_005211.1 | CSF1R | 2289 | GAGCAACAACCAAACCTACGA | 187 | CCTGCAGAGATGGGTATGAA | 919 | AGCCACTCCCCACGCTGTTGT | 1651 |
| CSF2.1 | NM_000758 | NM_000758.2 | CSF2 | 2779 | GAACCTGAAGGACTTTCTGCTTGT | 188 | CTCATCTGGCCGGTCTCACT | 920 | ATCCCCTTTGACTGCTGGGAGCCAG | 1652 |
| CSF2RA.2 | NM_006140 | NM_006140.3 | CSF2RA | 4477 | TACCACACCCAGCATTCCTC | 189 | CTAGAGGCTGGTGCCACTGT | 921 | CGCAGATCCGATTTCTCTGGGATC | 1653 |
| CSF3.2 | NM_000759 | NM_000759.1 | CSF3 | 377 | CCCAGGCCTCTGTGTCCTT | 190 | GGAGGACAGGAGCTTTTTCTCA | 922 | TGCATTTCTGAGTTTCATTCTCCTGCCTG | 1654 |
| CTGF.1 | NM_001901 | NM_001901.1 | CTGF | 2153 | GAGTTCAAGTGCCCTGACG | 191 | AGTTGTAATGGCAGCACAG | 923 | AACATCATGTTCTTCTTCATGACCTCGC | 1655 |
| CTSB.1 | NM_001908 | NM_001908.1 | CTSB | 382 | GGCCGAGATCTACAAAAACG | 192 | GCAGGAAGTCCGAATACACA | 924 | CCCCGTGGAGGAGCTTTCTC | 1656 |
| CTSD.2 | NM_001909 | NM_001909.1 | CTSD | 385 | GTACATGATCCCCTGTGAGAAGGT | 193 | GGGACAGCTTGTAGCCTTTGC | 925 | ACCCTGCCCGCGATCACACTGA | 1657 |
| CTSH.2 | NM_004390 | NM_004390.1 | CTSH | 845 | GCAAGTTCCAACCTGGAAAG | 194 | CATCGCTTCCTCGTCATAGA | 926 | TGGTACATCCTTGACAAAGCCGA | 1658 |
| CTSL1.2 | NM_001912 | NM_001912.1 | CTSL1 | 446 | GGGAGGCTTATCTCACTGAGTGA | 195 | CCATTGCAGCCTTCATTGC | 927 | TTGAGGCCCAGAGCAGTTACCAGATTCT | 1659 |
| CTSL2.1 | NM_001333 | NM_001333.2 | CTSL2 | 1667 | TGTCTCACTGAGCGAGCAGAA | 196 | ACCATTGCAGCCCTGATTG | 928 | CTTGAGGACGCGAACAGTCCACCA | 1660 |
| CTSS.1 | NM_004079 | NM_004079.3 | CTSS | 1799 | TGACAACGGCTTTCCAGTACAT | 197 | TCCATGGCTTTGTAGGGATAGG | 929 | TGATAACAAGGGCATCGACTCAGACGCT | 1661 |
| CUBN.1 | NM_001081 | NM_001081.2 | CUBN | 4110 | GAGGCCGTTACTGTGGCA | 198 | GAATCTTCAGCGTCAGGGC | 930 | TGCCCCATCCTATCACATCCTTCA | 1662 |
| CUL1.1 | NM_003592 | NM_003592.2 | CUL1 | 1889 | ATGCCCTGGTAATGTCTGCAT | 199 | GCCACCACAAGCCTTATCAAG | 931 | CAGCCACAAAGCCAGCGTCATTGT | 1663 |
| CUL4A.1 | NM_003589 | NM_003589.1 | CUL4A | 2780 | AAGCATCTTCCTGTTCTTGGA | 200 | AATCCATATCCCAGATGGA | 932 | TATGTGCTGCAGAACTCCACGCTG | 1664 |
| CX3CL1.1 | NM_002996 | NM_002996.3 | CX3CL1 | 6150 | GACCCTTGCCGTCTACCTG | 201 | GGAGTGTTCCTAGCACCTGG | 933 | TAGAACCCAGCCCATAAGAGGCCC | 1665 |
| CX3CR1.1 | NM_001337 | NM_001337.3 | CX3CR1 | 4507 | TTCCCAGTTGTGACATGAGG | 202 | GCTAAATGCAACCGTCTCAGT | 934 | ACTGAGGGCCAGCCTCAGATCCT | 1666 |

TABLE A-continued

| Gene | Accession Num | Sequence_ID | Official Symbol | Gene Version ID | F Primer Seq | SEQ ID NO. | R Primer Seq | SEQ ID NO. | Probe Seq | SEQ ID NO. |
|---|---|---|---|---|---|---|---|---|---|---|
| CXCL10.1 | NM_001565 | NM_001565.1 | CXCL10 | 2733 | GGAGCAAAATCGAT GCAGT | 203 | TAGGGAAGTGAT GGGAGAGG | 935 | TCTGTGTGTCCATC CTTGGAAGC | 1667 |
| CXCL12.1 | NM_000609 | NM_000609.3 | CXCL12 | 2949 | GAGCTACAGATGC CCATGC | 204 | TTTGAGATGCTT GACGTTGG | 936 | TTCTTCGAAAGCCAT GTTGCCAGA | 1668 |
| CXCL14.1 | NM_004887 | NM_004887.3 | CXCL14 | 3247 | TGCGCCCTTTCCTC TGTA | 205 | CAATGCGCACATA TACTGGG | 937 | TACCCTTAAGAACGC CCCTCCAC | 1669 |
| CXCL9.1 | NM_002416 | NM_002416.1 | CXCL9 | 5191 | ACCAGACCATTGTC TCAGAGC | 206 | GTTACCAGAGGC TAGCCAACA | 938 | TGTGGCTCTTTCCT GGCTACTCC | 1670 |
| CXCR4.3 | NM_003467 | NM_003467.1 | CXCR4 | 2139 | TGACCGCTTCTACC CCAATG | 207 | AGGATAAGGCCA ACCATGATGT | 939 | CTGAAACTGGAACAC AACCACCACAAG | 1671 |
| CXCR6.1 | NM_006564 | NM_006564.1 | CXCR6 | 4002 | CAGAGCCTGACGG ATGTGT | 208 | GCAGAGTGCAGA CAAACACC | 940 | CTGGTGAACCTACCC CTGGCTGAC | 1672 |
| CYP2C8.2 | NM_000770 | NM_000770.2 | CYP2C8 | 505 | CCGTGTTCAAGAG GAAGCTC | 209 | AGTGGGATCACA GGGTGAAG | 941 | TTTTCTCAACTCCTC CACAAGGCA | 1673 |
| CYP2C8v2.1 | NM_030878 | NM_030878.1 | | 5423 | GCTGTAGTGCACG AGATCCA | 210 | CAGTGGTCACTG CATGGG | 942 | ATACAGTGACCTTGT CCCCACCGG | 1674 |
| CYP3A4.2 | NM_017460 | NM_017460.3 | CYP3A4 | 586 | AGAACAAGGACAAC ATAGATCCTTACAT AT | 211 | GCAAACCTCATG CCAATGC | 943 | CACACCCTTTGGAAG TGGACCCGAAA | 1675 |
| CYR61.1 | NM_001554 | NM_001554.3 | CYR61 | 2752 | TGCTCATTCTTGAG GAGCAT | 212 | GTGGCTGCATTA GTGTCCAT | 944 | CAGCACCCTTGGCA GTTTCGAAAT | 1676 |
| DAG1.1 | NM_004393 | NM_004393.2 | DAG1 | 5968 | GTGACTGGGCTCA TGCCT | 213 | ATCCCACTTGTG CTCCTGTC | 945 | CAAGTCAGAGTTTCC CTGGTGCC | 1677 |
| DAPK1.3 | NM_004938 | NM_004938.1 | DAPK1 | 636 | CGCTGACATCATGA ATGTTCCT | 214 | TCTCTTTCAGCA ACCATGTGTCTT | 946 | TCATATCCAAACTCG CCTCCAGCCG | 1678 |
| DCBLD2.1 | NM_080927 | NM_080927.3 | DCBLD2 | 3821 | TCACCAGGGCAGG AAGTTTA | 215 | GGTTGCATACTC AGGCCC | 947 | CATGCCTATGCTGAA CCACTCCA | 1679 |
| DCC.3 | NM_005215 | NM_005215.1 | DCC | 3763 | AAATGTCCTCCTCG ACTGCT | 216 | TGAATGCCATCT TTCTTCCA | 948 | ATCACTGGAACTCCT CGGTCGGAC | 1680 |
| DCN.1 | NM_001920 | NM_001920.3 | DCN | 6151 | GAAGGCCACTATCA TCCTCCT | 217 | GCCTCTCTGTTG AAACGGTC | 949 | CTGCTTGCACAAGTT TCCTGGGCT | 1681 |
| DCXR.1 | NM_016286 | NM_016286.2 | DCXR | 6311 | CCATAGCGTCTACT GCTCCA | 218 | AGTCTCAGGGCC ATCACCT | 950 | TCAGCATGTCCAAGG GCACCC | 1682 |

TABLE A-continued

| Gene | Accession Num | Sequence_ID | Official Symbol | Gene Version ID | F Primer Seq | SEQ ID NO. | R Primer Seq | SEQ ID NO. | Probe Seq | SEQ ID NO. |
|---|---|---|---|---|---|---|---|---|---|---|
| DDC.1 | NM_000790 | NM_000790.3 | DDC | 5411 | CAGAGCCCAGACACCATGA | 219 | CCACGTAATCCACCATCTCC | 951 | CCTCTCCTTCGGAATTCACTTGCG | 1683 |
| DEFB1.1 | NM_005218 | NM_005218.3 | DEFB1 | 4124 | GATGGCCTCAGTGGTAACT | 220 | TGCTGACGCAATTGTAATGAT | 952 | CTCACAGGCCTTGGCCCACAGATCT | 1684 |
| DET1.1 | NM_017996 | NM_017996.2 | DET1 | 2643 | CTTGTGGAGATCACCCAATCAG | 221 | CCCGCCTGGATCTCAAACT | 953 | CTATGCCCGGGACTCGGGCCT | 1685 |
| DHPS.3 | NM_013407 | NM_013407.1 | DHPS | 1722 | GGGAGAACGGGATCAATAGGAT | 222 | GCATCAGCCAGTCCTCAAACT | 954 | CTCATTGGGCACCAGCAGTTTCC | 1686 |
| DIABLO.1 | NM_019887 | NM_019887.1 | DIABLO | 348 | CACAATGGCGGCTCTGAAG | 223 | ACACAAACACTGTCTGTACCTGAAGA | 955 | AAGTTACGCTGCGCGACAGCCAA | 1687 |
| DIAPH1.1 | NM_005219 | NM_005219.2 | DIAPH1 | 2705 | CAAGCAGTCAAGGAGAACCA | 224 | AGTTTGCTCGCCTCATCTT | 956 | TTCTTCTGTCTCCCGCCGCTTC | 1688 |
| DICER1.2 | NM_177438 | NM_177438.1 | DICER1 | 1898 | TCCAATTCCAGCATCACTGT | 225 | GGCAGTGAAGGCGATAAAGT | 957 | AGAAAGCTGTTTGTCTCCCAGCA | 1689 |
| DKFZP564O0082$$ | NM_015393 | NM_015393.2 | PARM1 | 3874 | CAGCTACACTGTCGCAGTCC | 226 | ATGAGGGCTGGAGCTTGAGG | 958 | TGCTGAGCCTCCACACTCATCTC | 1690 |
| DLC1.1 | NM_006094 | NM_006094.3 | DLC1 | 3018 | GATTCAGACGAGGATGAGCC | 227 | CACCTCTTGCTGTCCCTTTG | 959 | AAAGTCCATTTGCCACTGATGGCA | 1691 |
| DLL4.1 | NM_019074 | NM_019074.2 | DLL4 | 5273 | CACGGAGGTATAAGGCAGGAG | 228 | AGAAGGAAGGTCCAGCCG | 960 | CTACCTGGACATCCCTGCTCAGCT | 1692 |
| DPEP1.1 | NM_004413 | NM_004413.2 | DPEP1 | 6295 | GGACTCCAGATGCCAGGA | 229 | TAAGCCCAGGCGTCCTCT | 961 | CACATGCAAGGACCAGCATCTCCT | 1693 |
| DPYS.1 | NM_001385 | NM_001385.1 | DPYS | 6152 | AAAGAATGGCACCATGCAG | 230 | AGTCGGGTGTTGAGGGGT | 962 | CACCATGTCATGGGTCCACCTTTG | 1694 |
| DR4.2 | NM_003844 | NM_003844.1 | TNFRSF10$$ | 896 | TGCACAGAGGGGTGTGGGTTAC | 231 | TCTTCATCTGATTTACAAGCTGTACATG | 963 | CAATGCTTCCAACAATTTGTTTGCTTGCC | 1695 |
| DR5.2 | NM_003842 | NM_003842.2 | TNFRSF10$$ | 902 | CTCTGAGACAGTGCTTCGATGACT | 232 | CCATGAGGCCCAACTTCCT | 964 | CAGACTTGGTGCCCTTTGACTCC | 1696 |
| DUSP1.1 | NM_004417 | NM_004417.2 | DUSP1 | 2662 | AGACATCAGCTCCTGGTTCA | 233 | GACAAACACCCTTCCTCCAG | 965 | CGAGGCCATTGACTTCATAGACTCCA | 1697 |
| DUSP9.1 | NM_001395 | NM_001395.1 | DUSP9 | 6324 | CGTCCTAATCAACGTGCCTA | 234 | CCCGCAAAGAAAAAGTAACAG | 966 | CGTCGGAGCCTGCCTCTTC | 1698 |

TABLE A-continued

| Gene | Accession Num | Sequence_ID | Official Symbol | Gene Version ID | F Primer Seq | SEQ ID NO. | R Primer Seq | SEQ ID NO. | Probe Seq | SEQ ID NO. |
|---|---|---|---|---|---|---|---|---|---|---|
| E2F1.3 | NM_005225 | NM_005225.1 | E2F1 | 1077 | ACTCCCTCTACCCT TGAGCA | 235 | CAGGCCTCAGTT CCTTCAGT | 967 | CAGAAGAACAGCTCA GGGACCCCT | 1699 |
| EBAG9.1 | NM_004215 | NM_004215.3 | EBAG9 | 4151 | CGCTCCTGTTTTC TCATCTGT | 236 | ACCGAAACTGGG TGATGG | 968 | CAGTGGGTTTTGATT CCCACCATG | 1700 |
| ECRG4.1 | NM_032411 | NM_032411.1 | C2orf40 | 3869 | GCTCCTGCTCCTGT GCTG | 237 | TTTTGAAGCATC AGCTTGAGTT | 969 | ATTTCCACTTATGCC ACCTGGGCC | 1701 |
| EDG2.1 | NM_001401 | NM_001401.3 | LPAR1 | 4673 | ACGAGTCCATTGCC TTCTTT | 238 | GCTTGCTGACTG TGTTCCAT | 970 | CGAAGTGGAAAGCA TCTTGCCACA | 1702 |
| EDN1 endothelin | NM_001955 | NM_001955.1 | EDN1 | 331 | TGCCACCTGGACAT CATTTG | 239 | TGGACCTAGGGC TTCCAAGTC | 971 | CACTCCCGAGCACG TTGTTCCGT | 1703 |
| EDN2.1 | NM_001956 | NM_001956.2 | EDN2 | 2646 | CGACAAGGAGTGC GTCTACTTCT | 240 | CAGGCCGTAAGG AGCTGTCT | 972 | CCACTTGGACATCAT CTGGGTGAACACTG | 1704 |
| EDNRA.2 | NM_001957 | NM_001957.1 | EDNRA | 3662 | TTTCCTCAAATTTG CCTCAAG | 241 | TTACACATCCAA CCAGTGCC | 973 | CCTTTGCCTCAGGG CATCCTTTT | 1705 |
| EDNRB.1 | NM_000115 | NM_000115.1 | EDNRB | 3185 | ACTGTGAACTGCCT GGTGC | 242 | ACCACAGCATGG GTGAGAG | 974 | TGTACCTGCCCCTT TGTCATGTG | 1706 |
| EEF1A1.1 | NM_001402 | NM_001402.5 | EEF1A1 | 5522 | CGAGTGGAGACTG GTGTTCTC | 243 | CCGTTGTAACGT TGACTGGA | 975 | CAAAGGTGACCACCA TACCGGGTT | 1707 |
| EFNB1.2 | NM_004429 | NM_004429.3 | EFNB1 | 3299 | GGAGCCCGTATCC TGGAG | 244 | GGATAGATCACC AAGCCCTTC | 976 | CCCTCAACCCCAAGT TCCTGAGTG | 1708 |
| EFNB2.1 | NM_004093 | NM_004093.2 | EFNB2 | 2597 | TGACATTATCATCC CGCTAAGGA | 245 | GTAGTCCCGCT GACCTTCTC | 977 | CGGACAGCGTCTTC TGCCCTCACT | 1709 |
| EGF.3 | NM_001963 | NM_001963.2 | EGF | 158 | CTTTGCCTTGCTCT GTCACAGT | 246 | AAATACCTGACA CCCTTATGACAA ATT | 978 | AGAGTTTAACAGCCC TGCTCTGGCTGACTT | 1710 |
| EGFR.2 | NM_005228 | NM_005228.1 | EGFR | 19 | TGTCGATGGACTTC CAGAAC | 247 | ATTGGGACAGCT TGGATCA | 979 | CACCTGGGCAGCTG CCAA | 1711 |
| EGLN3.1 | NM_022073 | NM_022073.2 | EGLN3 | 2970 | GCTGGTCCTCTACT GCGG | 248 | CCACCATTGCCT TAGACCTC | 980 | CCGCTGGGCAAAT ACTACGTCAA | 1712 |
| EGR1.1 | NM_001964 | NM_001964.2 | EGR1 | 2615 | GTCCCCGCTGCAG ATCTCT | 249 | CTCCAGCTTAGG GTAGTTGTCCAT | 981 | CGGATCCTTTCCTCA CTCGCCCA | 1713 |
| EIF2C1.1 | NM_012199 | NM_012199.2 | EIF2C1 | 6454 | CCCTCACGGACTCT CAGC | 250 | TGGGTGACTTCC ACCTTCA | 982 | CGTTCGCTTCACCAA GGAGATCAA | 1714 |

TABLE A-continued

| Gene | Accession Num | Sequence_ID | Official Symbol | Gene Version ID | F Primer Seq | SEQ ID NO. | R Primer Seq | SEQ ID NO. | Probe Seq | SEQ ID NO. |
|---|---|---|---|---|---|---|---|---|---|---|
| EIF4EBP1.1 | NM_004095 | NM_004095.2 | EIF4EBP1 | 4275 | GGCGTGAAGAGTCACAGT | 251 | TTGGTAGTGCTCCACACGAT | 983 | TGAGATGGACATTTAAAGCACCAGCC | 1715 |
| ELTD1.1 | NM_022159 | NM_022159.3 | ELTD1 | 6154 | AGGTCTTGTGCAAGAGGAGC | 252 | AACCCCAAAGATCCAGGTG | 984 | CTCGCTCTTCTGTTCCTTCTCGGC | 1716 |
| EMCN.1 | NM_016242 | NM_016242.2 | EMCN | 3875 | AGGCACTGAGGGTGGAAA | 253 | CACCGGCAAAATAATACTGA | 985 | AATGCAAGCACTTCAGCAACAGC | 1717 |
| EMP1.1 | NM_001423 | NM_001423.1 | EMP1 | 986 | GCTAGTACTTTGATGCTCCCTTGAT | 254 | GAACAGTTGGAGGCCAAGTC | 986 | CCAGAGAGCCTCCCTGCAGCCA | 1718 |
| ENO2.1 | NM_001975 | NM_001975.2 | ENO2 | 6155 | TCCTTGGCTTACCTGACCTC | 255 | AACCCCAATGAGTAGGGCA | 987 | CTGTCTCTGCTCGCCCTCCTTTCT | 1719 |
| ENPEP.1 | NM_001977 | NM_001977.3 | ENPEP | 6156 | CACCTACACGGAGAACGGAC | 256 | CCTGGCATCTGTTGTTCA | 988 | TCAAGAGCATAGTGGCCACCGATC | 1720 |
| ENPP2.1 | NM_006209 | NM_006209.3 | ENPP2 | 6174 | CTCTGCGCACTAATACCTTC | 257 | TCCCTGGATAATTGGGTCTG | 989 | TAACTTCCTCTGGCATGGTTGGCC | 1721 |
| EPAS1.1 | NM_001430 | NM_001430.3 | EPAS1 | 2754 | AAGCCTTGGAGGGTTTCATTG | 258 | TGCTGATGTTTTCTGACAGAAGA | 990 | TGTCGCCATCTTGGGTCACCACG | 1722 |
| EPB41L3.1 | NM_012307 | NM_012307.2 | EPB41L3 | 4554 | TCAGTGCCATACGCTCTCAC | 259 | CTTGGGCTCCAGGTAGCA | 991 | CTCTCCTTCCCTCTGGCTCTGTG | 1723 |
| EPHA2.1 | NM_004431 | NM_004431.2 | EPHA2 | 2297 | CGCCTGTTCACCAAGATTGAC | 260 | GTGGCGTGCCTCGAAGTC | 992 | TGGCCCCGATGAGATCACCG | 1724 |
| EPHB1.3 | NM_004441 | NM_004441.3 | EPHB1 | 6508 | CCTTGGGAGGGAAGATCC | 261 | GAAGTGAACTTGCGGTAGGC | 993 | ATGGCCTTGGAGCTGTCCATCTC | 1725 |
| EPHB2.1 | NM_004442 | NM_004442.4 | EPHB2 | 2967 | CAACCAGGCAGCTCCATC | 262 | GTAATGCTGTCCACGGTGC | 994 | CACCTGATGCATGATGGACACTGC | 1726 |
| EPHB4.1 | NM_004444 | NM_004444.3 | EPHB4 | 2620 | TGAACGGGGTATCCTCCTTA | 263 | AGGTACCTCTCGGTCAGTGG | 995 | CGTCCCATTTGAGCCTGTCAATGT | 1727 |
| EPO.1 | NM_000799 | NM_000799.2 | EPO | 5992 | CAGTGCCAGCAATGACATCT | 264 | CAAGTTGCCCCTGTGACAT | 996 | CTCTCTGGACAGTTCCTCTGGCCC | 1728 |
| ErbB3.1 | NM_001982 | NM_001982.1 | ERBB3 | 93 | CGGTTATGTCATGCCAGATACAC | 265 | GAACTGAGACCACTGAAGAAGG | 997 | CCTCAAAGTACTCCCTCCTCCCG | 1729 |
| ERBB4.3 | NM_005235 | NM_005235.1 | ERBB4 | 407 | TGGCTCTTAATCAGTTTCGTTACCT | 266 | CAAGGCATATCGATCCTCATAAAGT | 998 | TGTCCACAGAATAATGCGTAAATTCTCCAG | 1730 |
| ERCC1.2 | NM_001983 | NM_001983.1 | ERCC1 | 869 | GTCCAGGTGGATGTGAAAGA | 267 | CGGCCAGGATACACATCTTA | 999 | CAGGAGGCCCTCAAGGAGCTG | 1731 |

TABLE A-continued

| Gene | Accession Num | Sequence_ID | Official Symbol | Gene Version ID | F Primer Seq | SEQ ID NO. | R Primer Seq | SEQ ID NO. | Probe Seq | SEQ ID NO. |
|---|---|---|---|---|---|---|---|---|---|---|
| ERCC4.1 | NM_005236 | NM_005236.1 | ERCC4 | 5238 | CTGCTGGAGTACGAGCGAC | 268 | GGGCGCACACTACTAGCC | 1000 | CTGTGCTGGAACTGCTCGACACT | 1732 |
| EREG.1 | NM_001432 | NM_001432.1 | EREG | 309 | ATAACAAAGTGAGCTCTGACATGAATG | 269 | CACACCTGCAGTAGTTTTGACTCA | 1001 | TTGTTTGCATGGACAGTGCATCTATCTGT | 1733 |
| ERG.1 | NM_004449 | NM_004449.3 | ERG | 3884 | CCAACACTAGGCTCCCCA | 270 | CCTCCGCCAGGTCTTTAGT | 1002 | AGCCATATGCCTTCTCATCTGGGC | 1734 |
| ERK1.3 | NM_002746 | Z16696.1 | MAPK3 | 548 | ACGGATCACAGTGGAGGAAG | 271 | CTCATCCGTCGGGTCATAGT | 1003 | CGTTGGCTCACCCCTACCTG | 1735 |
| ERK2.3 | NM_002745 | NM_002745.1 | MAPK1 | 557 | AGTTCTTGACCCCTGGTCCT | 272 | AAACGGCTCAAAGGAGTCAA | 1004 | TCTCCAGCCCGTCTTGGCTT | 1736 |
| ESPL1.3 | NM_012291 | NM_012291.1 | ESPL1 | 2053 | ACCCCAGACCGGATCAG | 273 | TGTAGGGCAGACTTCCTCAAACA | 1005 | CTGGCCCTCCATGTCCCCTTCACG | 1737 |
| ESRRG.3 | NM_001438 | NM_001438.1 | ESRRG | 2225 | CCAGACCACCATTGTTGAAGAT | 274 | AGTCTCTTGGCATCGAGTT | 1006 | CCCCAGACCAAGTGTGAATACATGCT | 1738 |
| F2.1 | NM_000506 | NM_000506.2 | F2 | 2877 | GCTGCATGTCTGGAAGGTAACTG | 275 | CCTGACCGGGTGATGTTCAC | 1007 | CCTCGGTAGTTCGTACCCAGACCCTCAG | 1739 |
| F3.1 | NM_001993 | NM_001993.2 | F3 | 12871 | GTGAAGGATGTGAAGCAGACGTA | 276 | AACCGGTGCTCTCCACATTC | 1008 | TGGCACGGGTCTTCTCCTACC | 1740 |
| FABP1.1 | NM_001443 | NM_001443.1 | FABP1 | 16175 | GGGTCCAAAGTGATCCAAAA | 277 | CCCTGTCATTGTCTCCAGC | 1009 | ACATTCCTCCCCCACCGTGAATTC | 1741 |
| FABP7.1 | NM_001446 | NM_001446.3 | FABP7 | 4048 | GGAGACAAAGTGGTCATCAGG | 278 | CTCTTCTCCCAGCTGGAAACT | 1010 | TCTCAGCACATTCAAGAACACGAGA | 1742 |
| FAP.1 | NM_004460 | NM_004460.2 | FAP | 3403 | CTGACCAGAACCACGGCT | 279 | GGAAGTGGGTCATGTGGG | 1011 | CGGCCTGTCCACGAACCACTTATA | 1743 |
| fas.1 | NM_000043 | NM_000043.1 | FAS | 42 | GGATTGCTCAACAACCATGCT | 280 | GGCATTAACACTTTTGGACCATAA | 1012 | TCTGACCCTCCTACCTCTGGTTCTTACGT | 1744 |
| fasl.2 | NM_000639 | NM_000639.1 | FASLG | 94 | GCACTTTGGGATTCTTTCCATTAT | 281 | GCATGTAAGAAGACCCTCACTGAA | 1013 | ACAACATTCTCGGTGCCTGTAACAAGAA | 1745 |
| FBXW7.1 | NM_033632 | NM_033632.1 | FBXW7 | 2644 | CCCCAGTTTCAACGAGACTT | 282 | GTTCCAGGAATGAAAGCACA | 1014 | TCATTGCTCCCTAAAGAGTTGGCACTC | 1746 |
| FCER1G.2 | NM_004106 | NM_004106.1 | FCER1G | 4073 | TGCCATCCTGTTTCTGTATGGA | 283 | TGCCTTTCGCACTTGGATCT | 1015 | TTGTCCTCACCCTCCTCTACTGTCGACTG | 1747 |
| FCGR3A.1 | NM_000569 | NM_000569.4 | FCGR3A | 3080 | GTCTCCAGTGTGGAAGGGAAAA | 284 | AGGAATGCAGCTACTCACTGG | 1016 | CCCATGATCTTCAAGCAGGGAAGC | 1748 |

TABLE A-continued

| Gene | Accession Num | Sequence_ID | Official Symbol | Gene Version ID | F Primer Seq | SEQ ID NO. | R Primer Seq | SEQ ID NO. | Probe Seq | SEQ ID NO. |
|---|---|---|---|---|---|---|---|---|---|---|
| FDPS.1 | NM_002004 | NM_002004.1 | FDPS | 516 | GGATGATTACCTTGACCTCTTTGG | 285 | TGCATTGTTGTCCTGGATGTC | 1017 | CAGTGTGACCGGCAAAATGGCAC | 1749 |
| FEN1.1 | NM_004111 | NM_004111.4 | FEN1 | 3938 | GTGGAAGGGTACGCCAG | 286 | CTCATGGCAACCAGTCCC | 1018 | CGCTGAGAGACTCTGTTCTCCCTGG | 1750 |
| FGF1.1 | NM_000800 | NM_000800.2 | FGF1 | 4561 | GACACCGACGGGCTTTTA | 287 | CAGCCTTTCCAGGAACAAAC | 1019 | ACGGCTCACAGACACCAATGAGG | 1751 |
| FGF2.2 | NM_002006 | NM_002006.2 | FGF2 | 681 | AGATGCAGGAGAGAGGAAGC | 288 | GTTTTGCAGCCTTACCCAAT | 1020 | CCTGCAGACTGCTTTTTGCCCAAT | 1752 |
| FGF9.1 | NM_002010 | NM_002010.1 | FGF9 | 6177 | CACAGCTGCCATACTTCGAC | 289 | AAGTAAGACTGCACCCTCGC | 1021 | AGGCCACCAGCCAGAATCCTGATA | 1753 |
| FGFR1.3 | NM_023109 | NM_023109.1 |  | 353 | CACGGGACATTCACCACATC | 290 | GGGTGCCATCCACTTCACA | 1022 | ATAAAAAGACAACCAACGGCCGACTGC | 1754 |
| FGFR2 isoform | NM_000141 | NM_000141.2 | FGFR2 | 2632 | GAGGGACTGTTGGCATGCA | 291 | GAGTGAGAATTCGATCCAAGTCTTC | 1023 | TCCCAGAGACCAACGTTCAAGCAGTTG | 1755 |
| FH.1 | NM_000143 | NM_000143.2 | FH | 4938 | ATGGTTGCAGCCCAAGTC | 292 | CAAAATGTCCATTGCTGCC | 1024 | ACAGTGACAGCAACATGGTTCCCC | 1756 |
| FHIT.1 | NM_002012 | NM_002012.1 | FHIT | 871 | CCAGTGGAGCGCTTCCAT | 293 | CTCTCTGGGTCGTCTGAAACAA | 1025 | TCGGCCACTTCATCAGGACGCAG | 1757 |
| FHL1.1 | NM_001449 | NM_001449.3 | FHL1 | 4005 | ATCCAGCCTTTGCCGAATA | 294 | CCTTGTGTAGCTGGAGGGACC | 1026 | TCCTATCTGCCACACATCCAGCGT | 1758 |
| FIGF.1 | NM_004469 | NM_004469.2 | FIGF | 3160 | GGTTCCAGTCTTTCTGTAGCTGT | 295 | GCCGCAGTTCTAGTTGCT | 1027 | ATTGGTGGCCACACCACCTCCTTA | 1759 |
| FILIP1.1 | NM_015687 | NM_015687.2 | FILIP1 | 4510 | ACACCGGTCACAACGTCAT | 296 | CTGGGATGACCCGTCTTG | 1028 | CCTGACACTGACTGGGTTCCTCGA | 1760 |
| FKBP1A.1 | NM_000801 | NM_000801.2 | FKBP1A | 6330 | CTGCCCTGACTGAATGTGTT | 297 | TACGAGGAGAAAGGGGAAGA | 1029 | TCACTCAGCTTTGCTTCCGACACC | 1761 |
| FLJ22655.1 | NM_024730 | NM_024730.2 | RERGL | 3870 | CTCCTTCACACAGAACCTTTCA | 298 | AGGCAAACTGGGATCGCT | 1030 | CACACTCACCCTAACCTACTGGGG | 1762 |
| FLT1.1 | NM_002019 | NM_002019.3 | FLT1 | 6062 | GGCTCCTGAATCTATCTTTG | 299 | TCCCACAGCAATACTCCGTA | 1031 | CTACAGCACCAAGAGCGACGTG | 1763 |
| FLT3LG.1 | NM_001459 | NM_001459.2 | FLT3LG | 6178 | TGGGTCCAAGATGCAAGG | 300 | GAAAGGCACATTTGGTGACA | 1032 | AGTGTATCCGTGTTCACGCGCT | 1764 |
| FLT4.1 | NM_002020 | NM_002020.1 | FLT4 | 2782 | ACCAAGAAGCTGAGGACCTG | 301 | CCTGGAAGCTGTAGCAGACA | 1033 | AGCCCGTGACCATGGAAGATCT | 1765 |

TABLE A-continued

| Gene | Accession Num | Sequence_ID | Official Symbol | Gene Version ID | F Primer Seq | SEQ ID NO. | R Primer Seq | SEQ ID NO. | Probe Seq | SEQ ID NO. |
|---|---|---|---|---|---|---|---|---|---|---|
| FN1.1 | NM_002026 | NM_002026.2 | FN1 | 4528 | GGAAGTGACAGAC GTGAAGGT | 302 | ACACGGTAGCCG GTCACT | 1034 | ACTCTCAGGCGGTG TCCACATGAT | 1766 |
| FOLR1.1 | NM_016730 | NM_016730.1 | FOLR1 | 859 | GAACGCCAAGCAC CACAAG | 303 | CCAGGGTCGACA CTGCTCAT | 1035 | AAGCCAGGCCCCGA GGACAAGTT | 1767 |
| FOS.1 | NM_005252 | NM_005252.2 | FOS | 2418 | CGAGCCCTTTGATG ACTTCCT | 304 | GGAGCGGGCTG TCTCAGA | 1036 | TCCCAGCATCATCCA GGCCCAG | 1768 |
| FRAP1.1 | NM_004958 | NM_004958.2 | MTOR | 3095 | AGCGTAGAGACT GTGGACC | 305 | ATGATCCGGAG GCATAGT | 1037 | CCTGACGGAGTCC TGGATTTCAC | 1769 |
| FRP1.3 | NM_003012 | NM_003012.2 | SFRP1 | 648 | TTGGTACCTGTGG GTTAGCA | 306 | CACATCCAAATG CAAACTGG | 1038 | TCCCCAGGGTAGAAT TCAATCAGAGC | 1770 |
| FST.1 | NM_006350 | NM_006350.2 | FST | 2306 | GTAAGTCGGATGA GCCTGTCTGT | 307 | CAGCTTCCTTCA TGGCACACT | 1039 | CCAGTGACAATGCCA CTTATGCCAGC | 1771 |
| FZD2.2 | NM_001466 | NM_001466.2 | FZD2 | 3760 | TGGATCCTCACCTG GTCG | 308 | GCGCTGCATGTC TACCAA | 1040 | TGCGCTTCCACCTTC TTCACTGTC | 1772 |
| G-Catenin.1 | NM_002230 | NM_002230.1 | JUP | 770 | TCAGCAGCAAGGG CATCAT | 309 | GGTGGTTTTCTT GAGCGTGTACT | 1041 | CGCCCGCAGGCCTC ATCCT | 1773 |
| GADD45B.1 | NM_015675 | NM_015675.1 | GADD45B | 2481 | ACCCTGACACAGAC CACACT | 310 | TGGGAGTTCATG GGTACAGA | 1042 | AACTTCAGGCCCCAGC TCCCAAGTC | 1774 |
| GAS2.1 | NM_005256 | NM_005256.2 | GAS2 | 6451 | AACATGTCATGTC CGTGTG | 311 | GGGGTCGTGTTT CAACAAAT | 1043 | CCTGCAAAAGTTTCC CAGCCTCCT | 1775 |
| GATA3.3 | NM_002051 | NM_002051.1 | GATA3 | 1 | CAAAGGAGCTCACT GTGGTGCT | 312 | GAGTCAGAATGG CTTATTCACAGATG | 1044 | TGTTCCAACCACTGA ATCTGGACC | 1776 |
| GATM.1 | NM_001482 | NM_001482.2 | GATM | 6296 | GATCTCCGGCTTGG ACGAAC | 313 | GTAGCTGCCTGG GTGCTCT | 1045 | AAAGTTCGCTGCACC CATCCTGTC | 1777 |
| GBL.1 | NM_022372 | NM_022372.3 | MLST8 | 6302 | GCTGTCAATAGCAC CGGAA | 314 | GGTCACCTCGTC ACCAATG | 1046 | CCCCCGTCAGATTCC AGACATAGC | 1778 |
| GBP2.2 | NM_004120 | NM_004120.2 | GBP2 | 2060 | GCATGGGAACCAT CAACCA | 315 | TGAGGAGTTTGC CTTGATTCG | 1047 | CCATGGACCAACTTC ACTATGTGACAGAGC | 1779 |
| GCLC.3 | NM_001498 | NM_001498.1 | GCLC | 330 | CTGTTGCAGGAAG GCATTGA | 316 | GTCATGGGTCT CTTAATAAAGAGA TGAG | 1048 | CATCTCCTGGCCCA GCATGTT | 1780 |
| GCLM.2 | NM_002061 | NM_002061.1 | GCLM | 704 | TGTAGAATCAAACT CTTCATCATCAACT AG | 317 | CACAGAATCCAG CTGTGCAACT | 1049 | TGCAGTTGACATGG CCTGTTCAGTCC | 1781 |

TABLE A-continued

| Gene | Accession Num | Sequence_ID | Official Symbol | Gene ID Version | F Primer Seq | SEQ ID NO. | R Primer Seq | SEQ ID NO. | Probe Seq | SEQ ID NO. |
|---|---|---|---|---|---|---|---|---|---|---|
| GFRA1.1 | NM_005264 | NM_005264.3 | GFRA1 | 6179 | TCCGGGTTAAGAAC AAGCC | 318 | GTGGCAAAACAT GAGTGGG | 1050 | TTTCATTCTCAGACC CTGCTGGCC | 1782 |
| GJA1.1 | NM_000165 | NM_000165.2 | GJA1 | 2600 | GTTCACTGGGCGT GTATGG | 319 | AAATACCAACAT GCACCCTCTT | 1051 | ATCCCCTCCCTCCC ACCCATCTA | 1783 |
| GLYAT1 | NM_201648 | NM_201648.2 | GLYAT | 6180 | TACCATTGCAAGGT GCCC | 320 | GGATGCTGGGA GGCTCTT | 1052 | AGGATTTCTCCAGCA TCTGCAGCA | 1784 |
| GMNN.1 | NM_015895 | NM_015895.3 | GMNN | 3880 | GTTCGCTACGAGG ATTGAGC | 321 | TGCGTACCACT TCCTGC | 1053 | CCTCTTGCCCACTTA CTGGGTGGA | 1785 |
| GNAS.1 | NM_000516 | NM_000516.3 | GNAS | 2665 | GAACGTGCCTGAC TTTGACTT | 322 | ACTCCTTCATCC TCCCACAG | 1054 | CCTCCCGAATTCTAT GAGCATGCC | 1786 |
| GPC3.1 | NM_004484 | NM_004484.2 | GPC3 | 659 | TGATGCGCCTGAA AACAGT | 323 | CGAGGTTGTGAA AGTGCTTATC | 1055 | AGCAGGCAACTCCG AAGGACAACG | 1787 |
| GPX1.2 | NM_000581 | NM_000581.2 | GPX1 | 2955 | GCTTATGACCGACC CCAA | 324 | AAAGTTCCAGGC AACATCGT | 1056 | CTCATCACCTGGTCT CCGGTGTGT | 1788 |
| GPX2.2 | NM_002083 | NM_002083.1 | GPX2 | 890 | CACACAGATCTCCT ACTCCATCA | 325 | GGTCCAGCAGTG TCTCCTGAA | 1057 | CAATGCTGATCCTAA GGCTCCTCAGG | 1789 |
| GPX3.1 | NM_002084 | NM_002084.3 | GPX3 | 6271 | GCTCTAGGTCCAAT TGTTCTGC | 326 | TGGAGGCAGTG GGAGATG | 1058 | ACTGATACCTCAACC TTGGGGCCA | 1790 |
| GRB14.1 | NM_004490 | NM_004490.1 | GRB14 | 2784 | TCCCACTGAAGCC CTTTCAG | 327 | AGTGCCCAGGC GTAAACATC | 1059 | CCTCCAAGCGAGTC CTTCTTCAACCG | 1791 |
| GRB7.2 | NM_005310 | NM_005310.1 | GRB7 | 20 | CCATCTGCATCCAT CTTGTT | 328 | GGCCACCAGGG TATTATCTG | 1060 | CTCCCCACCCTTGAG AAGTGCCT | 1792 |
| GRO1.2 | NM_001511 | NM_001511.1 | CXCL1 | 86 | CGAAAAGATGCTGA ACAGTGACA | 329 | TCAGGAACAGCC ACCAGTGA | 1061 | CTTCCTCCTCCCTTC TGGTCAGTTGGAT | 1793 |
| GSTM1.1 | NM_000561 | NM_000561.1 | GSTM1 | 727 | AAGCTATGAGGAAA AGAAGTACACGAT | 330 | GGCCCAGCTTGA ATTTTTCA | 1062 | TCAGCCACTGGCTTC TGTCATAATCAGGAG | 1794 |
| GSTM3.2 | NM_000849 | NM_000849.3 | GSTM3 | 731 | CAATGCCATCTTGC GCTACAT | 331 | GTCCACTCGAAT CTTTTCTTTCA | 1063 | CTCCAAGCACAACA TGTGTGGTGAGA | 1795 |
| GSTp.3 | NM_000852 | NM_000852.2 | GSTP1 | 66 | GAGACCCTGCTGT CCCAGAA | 332 | GGTTGTAGTCAG CGAAGGAGATC | 1064 | TCCCACAATGAAGGT CTTGCCTCCCT | 1796 |
| GSTT1.3 | NM_000853 | NM_000853.1 | GSTT1 | 813 | CACCATCCCCACCC TGTCT | 333 | GGCCTCAGTGTG CATCATTCT | 1065 | CACAGCCGCCTGAA AGCCACAAT | 1797 |
| GZMA.1 | NM_006144 | NM_006144.2 | GZMA | 4111 | GAAAGAGTTTCCCT ATCCATGC | 334 | TGCTTTTTCCGT CAGCTGTAA | 1066 | AGCCACACGCGAAG GTGACCTTAA | 1798 |

TABLE A-continued

| Gene | Accession Num | Sequence_ID | Official Symbol | Gene Version ID | F Primer Seq | SEQ ID NO. | R Primer Seq | SEQ ID NO. | Probe Seq | SEQ ID NO. |
|---|---|---|---|---|---|---|---|---|---|---|
| HADH.1 | NM_005327 | NM_005327.2 | HADH | 6181 | CCACCAGACAAGACCGATTC | 335 | CCACAAGTTCATGACAGGC | 1067 | CTGCCTCCATTCTTCAACCCAG | 1799 |
| HAVCR1.1 | NM_012206 | NM_012206.2 | HAVCR1 | 6284 | CCACCCAAGGTCACGACTAC | 336 | GAACAGTGGTGCTCGTTCG | 1068 | TCACAACTGTTCCAACCGTCACGA | 1800 |
| HDAC1.1 | NM_004964 | NM_004964.2 | HDAC1 | 2602 | CAAGTACCACAGCGATGACTACATTAA | 337 | GCTTGCTGTACTCCGACATGTT | 1069 | TTCTTGCGCTCCATCCGTCCAGA | 1801 |
| Hepsin.1 | NM_002151 | NM_002151.1 | HPN | 814 | AGGCTGCTGGAGGTCATCTC | 338 | CTTCCTCCGGCCACAGTCT | 1070 | CCAGAGGCCGTTTCTTGGCCG | 1802 |
| HER2.3 | NM_004448 | NM_004448.1 | ERBB2 | 13 | CGGTGTGAGAAGTGCAGCAA | 339 | CCTCTCCGCAAGTGCTCCAT | 1071 | CCAGACCATAGCACACTCGGGCAC | 1803 |
| HGD.1 | NM_000187 | NM_000187.2 | HGD | 6303 | CTCAGGTCTGCCCCTACAAT | 340 | TTATTGGTGCTCCGTGGAC | 1072 | CTGAGCAGCTCTCAGGATCGGGTT | 1804 |
| HGF.4 | M29145 | M29145.1 |  | 457 | CCGAAATCCAGATGATGATG | 341 | CCCAAGGAATGAGTGGATTT | 1073 | CTCATGGACCCTGTGCTACACG | 1805 |
| HGFAC.1 | NM_001528 | NM_001528.2 | HGFAC | 2704 | CAGGACACAAGTGCCAGATT | 342 | GCAGGGAGCTGGAGTAGC | 1074 | CGCTTCACGTTCTCATCCAAGTGG | 1806 |
| HIF1A.3 | NM_001530 | NM_001530.1 | HIF1A | 399 | TGAACATAAAGTCTGCAACATGAA | 343 | TGAGGTTGGTTACTGTTGGTATCATATA | 1075 | TTGCACTGCACAGGCCCATTCAC | 1807 |
| HIF1AN.1 | NM_017902 | NM_017902.2 | HIF1AN | 7211 | TGTTGGCCAGGTCTCACTG | 344 | GCATCATAGGGCCTGGAG | 1076 | CTCTAGCACCAGTTAGCCTCGGGCAG | 1808 |
| HIST1H1D.1 | NM_005320 | NM_005320.2 | HIST1H1D | 4013 | AAAAAGGCGAAGAAGGCAG | 345 | GCTCAGATACTGGGGGTCC | 1077 | AACTGCTGGGAAACGCAAAGCATC | 1809 |
| HLA-B.1 | NM_005514 | NM_005514.6 | HLA-B | 6334 | CTTGTGAGGGACTGAGATGC | 346 | TGCAGAAGAGATGCCAGAG | 1078 | TCTTCACGCCTCCCCTTTGTGA | 1810 |
| HLA-DPA1.1 | NM_033554 | NM_033554.2 | HLA-DPA1 | 6314 | CGCCCTGAAGACAGAATGT | 347 | TCCGAGACTCAGCAGGAAA | 1079 | TGATCTTGAGAGCCCTCTCCTTGGC | 1811 |
| HLA-DPB1.1 | NM_002121 | NM_002121.4 | HLA-DPB1 | 1740 | TCCATGATGGTTCTGCAGGTT | 348 | TGAGCAGCACCATCAGTAACG | 1080 | CCCCGGACAGTGGCTCTGACG | 1812 |
| HLA-DQB1.1 | NM_002123 | NM_002123.3 | HLA-DQB1 | 6304 | GGTCTGCTCGGTGACAGATT | 349 | CTTCCTGATCATTCCGAAACC | 1081 | TATCCAGGCCAGATCAAAGTCCGG | 1813 |
| HLADQA1.2 | NM_002122 | NM_002122.3 | HLA-DQA1 | 4071 | CATCTTTCCTCTGTGGTCA | 350 | GCTGGTCTCAGAAACACCTTC | 1082 | TGTGACTGACTGCCCATTGCTCAG | 1814 |

TABLE A-continued

| Gene | Accession Num | Sequence_ID | Official Symbol | Gene Version ID | F Primer Seq | SEQ ID NO. | R Primer Seq | SEQ ID NO. | Probe Seq | SEQ ID NO. |
|---|---|---|---|---|---|---|---|---|---|---|
| HMGB1.1 | NM_002128 | NM_002128.3 | HMGB1 | 2162 | TGGCCTGTCCATTGGTGAT | 351 | GCTTGTCATCTGCAGCAGTGTT | 1083 | TTCCACATCTCTCCCAGTTCTTCGCAA | 1815 |
| HNRPAB.1 | NM_004499 | NM_004499.3 | HNRNPAB | 6051 | AGCAGGAGCGACCAACTGA | 352 | GTTTGCCAAGTTAAATTGGTACATAAT | 1084 | CTCCATATCCAAACAAAGCATGTGCG | 1816 |
| HPCAL1.1 | NM_002149 | NM_002149.2 | HPCAL1 | 6182 | CAGGCAGATGGACACCAA | 353 | GTCGCTCTTGGCACCTCT | 1085 | TCTTCCAAGGACAGTTTGCCGTCA | 1817 |
| HPD.1 | NM_002150 | NM_002150.2 | HPD | 6183 | AGCTGAAGACCGCCAAGAT | 354 | CGTCGTAGTCCACCAGGATT | 1086 | AGCTCCTCCAGGGCATCAATGTTC | 1818 |
| HSD11B2.1 | NM_000196 | NM_000196.3 | HSD11B2 | 6185 | CCAACCTGCCTCAAGAGC | 355 | GGAACTGCCCATGCAAGT | 1087 | CTGCAGGCCTACGGCAAGGACTAC | 1819 |
| HSP90AB1.1 | NM_007355 | NM_007355.2 | HSP90AB1 | 5456 | GCATTGTGACCAGCACCTAC | 356 | GAAGTGCCTGGGCTTTCAT | 1088 | ATCCGCTCCATATTGGCTGTCCAG | 1820 |
| HSPA1A.1 | NM_005345 | NM_005345.4 | HSPA1A | 2412 | CTGCTCGACAGTCCACTA | 357 | CAGGTTCGCTCTGGGAAG | 1089 | AGAGTGACTCCCGTTGTCCCAAGG | 1821 |
| HSPA8.1 | NM_006597 | NM_006597.3 | HSPA8 | 2563 | CCTCCCTCTGGTGGTGCTT | 358 | GCTACATCTACACTTGGTTGGCTTAA | 1090 | CTCAGGGCCCACCATTGAAGAGTTG | 1822 |
| HSPB1.1 | NM_001540 | NM_001540.2 | HSPB1 | 2416 | CCGACTGGAGGAGCATAAA | 359 | ATGCTGGCTGACTCTGCTC | 1091 | CGCACTTTTCTGAGCAGACGTCCA | 1823 |
| HSPG2.1 | NM_005529 | NM_005529.2 | HSPG2 | 1783 | GAGTACGTGTGCCGAGTGTT | 360 | CTCAATGGTGACCAGGACA | 1092 | CAGCTCCGTGCCTCTAGAGGCCT | 1824 |
| HTATIP.1 | NM_006388 | NM_006388.2 | KAT5 | 3893 | TCGAATTGTTTGGGCACTG | 361 | GCCTGGTGCTGACGGTAT | 1093 | TGAGGACTCCCAGGACAGCTCTGA | 1825 |
| HYAL1.1 | NM_153281 | NM_153281.1 | HYAL1 | 4524 | TGGCTGTGGAGTTCAAATGT | 362 | CCAATCACCACATGCTCTTC | 1094 | CGATGTCTACCCTGGCTGGCAG | 1826 |
| HYAL2.1 | NM_033158 | NM_033158.2 | HYAL2 | 5192 | CAACCATGCACTCCCAGTC | 363 | ACTAAGCCCCGTGAGCCT | 1095 | TCTTCACGACACCACCTACAGCC | 1827 |
| HYAL3.1 | NM_003549 | NM_003549.2 | HYAL3 | 6298 | TATGTCCGCCTTCACACACC | 364 | CAATGGACTGCACAAGGTCA | 1096 | TGGGACAGGAACCTCCCAGATCTC | 1828 |
| ICAM1.1 | NM_000201 | NM_000201.1 | ICAM1 | 1761 | GCAGCAGTGACCATCTACAGCTT | 365 | CTTCTGAGACCTCTGGCTTCGT | 1097 | CCGCGCCCAACGTGATTCT | 1829 |
| ICAM2.1 | NM_000873 | NM_000873.2 | ICAM2 | 2472 | GGTCATCCTGACACTGCAAC | 366 | TGCACTCAATGGTGAAGGAC | 1098 | TTGCCAAGCCACCAAAGTG | 1830 |

TABLE A-continued

| Gene | Accession Num | Sequence_ID | Official Symbol | Gene Version ID | F Primer Seq | SEQ ID NO. | R Primer Seq | SEQ ID NO. | Probe Seq | SEQ ID NO. |
|---|---|---|---|---|---|---|---|---|---|---|
| ICAM3.1 | NM_002162 | NM_002162.3 | ICAM3 | 7219 | GCCTTCAATCTCAGCAACG | 367 | GAGAGCCATTGCAGTACAC | 1099 | CAGAGGATCCGACTGTTGCCAGTC | 1831 |
| ID1.1 | NM_002165 | NM_002165.1 | ID1 | 354 | AGAACCGCAAGTGAGCAA | 368 | TCCAACTGAAGGTCCCTGATG | 1100 | TGGAGATTCTCCAGCACGTCATCGAC | 1832 |
| ID2.4 | NM_002166 | NM_002166.1 | ID2 | 37 | AACGACTGCTACTCCAAGCTCAA | 369 | GGATTTCCATCTTGCTCACCTT | 1101 | TGCCCAGCATCCCCAGAACAA | 1833 |
| ID3.1 | NM_002167 | NM_002167.3 | ID3 | 6052 | CTTCACCAAATCCCTTCCTG | 370 | CTCTGGTCTTCAGGCCACA | 1102 | TCACAGTCTCTTCGCTCCTGAGCAC | 1834 |
| IFI27.1 | NM_005532 | NM_005532.2 | IFI27 | 2770 | CTCTCCGGATTGACCAAGTT | 371 | TAGAACCTCGCAATGACAGC | 1103 | CAGACCCAATGGAGCCCAGGAT | 1835 |
| IGF1.2 | NM_000618 | NM_000618.1 | IGF1 | 60 | TCCGGAGCTGTGATCTAAGGA | 372 | CGGACAGAGCGAGCTGACTT | 1104 | TGTATTGCGCACCCCTCAAGCCTG | 1836 |
| IGF1R.3 | NM_000875 | NM_000875.2 | IGF1R | 413 | GCATGGTAGCCGAAGATTTCA | 373 | TTTCCGGTAATAGTCTGTCTCATAGATATC | 1105 | CGGTCATACCAAAATCTCCGATTTTGA | 1837 |
| IGF2.2 | NM_000612 | NM_000612.2 | IGF2 | 166 | CCGTGCTTCCGGACAACTT | 374 | TGGACTGCTTCCAGGTGTCA | 1106 | TACCCCGTGGGCAAGTTCTTCCAA | 1838 |
| IGFBP2.1 | NM_000597 | NM_000597.1 | IGFBP2 | 373 | GTGGACAGCACCATGAACA | 375 | CCTTCATACCCGACTTGAGG | 1107 | CTTCCGGCCAGCACTGCCTC | 1839 |
| IGFBP3.1 | NM_000598 | NM_000598.4 | IGFBP3 | 6657 | ACATCCCAACGCATGCTC | 376 | CCACGCCCTTGTTTCAGA | 1108 | ACACCACAGAAGGCTGTGAGCTCC | 1840 |
| IGFBP5.1 | NM_000599 | NM_000599.1 | IGFBP5 | 594 | TGGACAAGTACGGGATGAAGCT | 377 | CGAAGGTGTGGCACTGACCTGG | 1109 | CCCGTCAACGTACTCCATGCCTGG | 1841 |
| IGFBP6.1 | NM_002178 | NM_002178.1 | IGFBP6 | 836 | TGAACCGCAGAGACCAACAG | 378 | GTCTTGACACCCGCAGCAAT | 1110 | ATCAGGCACCTCTACCAGCCCCTC | 1842 |
| IL-7.1 | NM_000880 | NM_000880.2 | IL7 | 2084 | GCGGTGATTCGAAATTCG | 379 | CTCTCCTGGCACCTGCTT | 1111 | CTCTGGTCCTCATCCAGGTGCGC | 1843 |
| IL-8.1 | NM_000584 | NM_000584.2 | IL8 | 2087 | AAGGACCATCTCACTGTGTGTAAAC | 380 | ATCAGGAAGGCTGCCAAGAG | 1112 | TGACTTCCAAGCTGGCCGTGGC | 1844 |
| IL10.3 | NM_000572 | NM_000572.1 | IL10 | 909 | GGCGCTGTGTCATCGATTTCTT | 381 | TGGAGCTTATTAAAGGCATTCTTCA | 1113 | CTGTCCACGGCCTTGCTCTTG | 1845 |
| IL11.2 | NM_000641 | NM_000641.2 | IL11 | 2166 | TGGAAGGTTCCACAAGTCAC | 382 | TCTTGACCTTGTAGTTTGT | 1114 | CCTGTGATCAACAGTACCCGTATGGG | 1846 |

TABLE A-continued

| Gene | Accession Num | Sequence_ID | Official Symbol | Gene Version ID | F Primer Seq | SEQ ID NO. | R Primer Seq | SEQ ID NO. | Probe Seq | SEQ ID NO. |
|---|---|---|---|---|---|---|---|---|---|---|
| IL15.1 | NM_000585 | NM_000585.2 | IL15 | 6187 | GGCTGGGTACCAATGCTG | 383 | TGAGAGCCAGTAGTCAGTGTT | 1115 | CAGCTATGCTGGTAGGCTCCTGCC | 1847 |
| IL1B.1 | NM_000576 | NM_000576.2 | IL1B | 2755 | AGCTGAGGAAGATGCTGGTT | 384 | GGAAAGAAGGTGCTCAGGTC | 1116 | TGCCCACAGACCTTCCAGGAGAAT | 1848 |
| IL6.3 | NM_000600 | NM_000600.1 | IL6 | 324 | CCTGAACCTTCCAAAGATGG | 385 | ACCAGGCAAGTCTCCTCATT | 1117 | CCAGATTGGAAGCATCCATCTTTTTCA | 1849 |
| IL6ST.3 | NM_002184 | NM_002184.2 | IL6ST | 2317 | GGCCTAATGTTCCAGATCCT | 386 | AAAATTGTGCCTTGGAGAG | 1118 | CATATTGCCCAGTGGTCACCTCACA | 1850 |
| ILT-2.2 | NM_006669 | NM_006669.1 | LILRB1 | 583 | AGCCATCACTCTCAGTGCAG | 387 | ACTGCAGAGTCAGGGTCTCC | 1119 | CAGGTCCTATCGTGGCCCCTGA | 1851 |
| IMP3.1 | NM_018285 | NM_018285.2 | IMP3 | 4751 | GTGGACTCGTCCAAGATCAA | 388 | GGCTTCCAGATCGAAGTCAT | 1120 | CTCATTGTACTCTAGCACGTGCCGC | 1852 |
| INDO.1 | NM_002164 | NM_002164.3 | IDO1 | 5124 | CGCCTTGCACGTCTAGTTC | 389 | ATCTCCATGATGACCTTTGCCC | 1121 | ACATATGCCATGGTGATGCATCCC | 1853 |
| INHBA.1 | NM_002192 | NM_002192.1 | INHBA | 2635 | GTGCCCGAGCCATATAGCA | 390 | CGGTAGTGGTTGATGACTGTTGA | 1122 | ACGTCCGGTCCTCACTGTCCTTCC | 1854 |
| INHBB.1 | NM_002193 | NM_002193.1 | INHBB | 2636 | AGCCTCCAGGATACCAGCAA | 391 | TCTCCGACTGACAGGCATTTG | 1123 | AGCTAAGCTGCCATTTGTCACCG | 1855 |
| INSR.1 | NM_001079817 | NM_001079817 | INSR | 6455 | CAGTCTCCGAGAGCGGATT | 392 | GTGATGGCAGGTGAAGCC | 1124 | AGTTCCTCAATGAGGCCTCGGTCA | 1856 |
| IQGAP2.1 | NM_006633 | NM_006633.2 | IQGAP2 | 6453 | AGAGACACCAGCAACTGCG | 393 | ATCATTGCACGGCTCACC | 1125 | CCGTGGCATGGTCTACCTCCTGTT | 1857 |
| ISG20.1 | NM_002201 | NM_002201.4 | ISG20 | 6189 | GTGTCAGACTGAAGCCCCAT | 394 | GTTGCTGTCCCAAAAAGCC | 1126 | AAAGCCTCAGTCCCTGCGGAACG | 1858 |
| ITGA3.2 | NM_002204 | NM_002204.1 | ITGA3 | 840 | CCATGATCCTCACTCTGCTG | 395 | GAAGCTTTGTAGCCCGGTGAT | 1127 | CACTCCAGACCTCGCTTAGCATGG | 1859 |
| ITGA4.2 | NM_000885 | NM_000885.2 | ITGA4 | 2867 | CAACGCTTCAGTGATCAATCC | 396 | GTCTGGCCGGGATTCTTT | 1128 | CGATCCTGCCATCTGTAAATCGCCC | 1860 |
| ITGA5.1 | NM_002205 | NM_002205.1 | ITGA5 | 2668 | AGGCCAGCCTACATTATCA | 397 | GTCTTCTCCACAGTCCAGCA | 1129 | TCTGAGCCTTGTCCTCTATCCGGC | 1861 |
| ITGA6.2 | NM_000210 | NM_000210.1 | ITGA6 | 2791 | CAGTGACAAACAGCCCTTCC | 398 | GTTTAGCCTCATGGGCGTC | 1130 | TCGCCATCTTTTGTGGGATTCCTT | 1862 |
| ITGA7.1 | NM_002206 | NM_002206.1 | ITGA7 | 259 | GATATGATTGGTCGCTGCTTTG | 399 | AGAACTTCCATTCCCCACCAT | 1131 | CAGCCAGGAGGACCTGGCCATCG | 1863 |

TABLE A-continued

| Gene | Accession Num | Sequence_ID | Official Symbol | Gene Version ID | F Primer Seq | SEQ ID NO. | R Primer Seq | SEQ ID NO. | Probe Seq | SEQ ID NO. |
|---|---|---|---|---|---|---|---|---|---|---|
| ITGAV.1 | NM_002210 | NM_002210.2 | ITGAV | 2671 | ACTCGGACTGCACAAGCTATT | 400 | TGCCATCACCATTGAAATCT | 1132 | CCGACAGCCACAGAATAACCAAA | 1864 |
| ITGB1.1 | NM_002211 | NM_002211.2 | ITGB1 | 2669 | TCAGAATTGGATTTGGCTCA | 401 | CCTGAGCTTAGCTGGTGTTG | 1133 | TGCTAATGTAAGGCATCACAGTCTTTCCA | 1865 |
| ITGB3.1 | NM_000212 | NM_000212.2 | ITGB3 | 6056 | ACCGGGGAGCCCTACATGA | 402 | CCTTAAGCTCTTTCACTGACTCAATCT | 1134 | AAATACCTGCAACCGTTACTGCCGTGAC | 1866 |
| ITGB4.2 | NM_000213 | NM_000213.2 | ITGB4 | 2793 | CAAGGTGCCCTCAGTGGA | 403 | GCGCACACCTTCATCTCAT | 1135 | CACCAACCTGTACCCGTATTGCGA | 1867 |
| ITGB5.1 | NM_002213 | NM_002213.3 | ITGB5 | 2670 | TCGTGAAAGATGACCAGGAG | 404 | GGTGAACATCATGACGCAGT | 1136 | TGTATGTTTCTACAAAACCGCCAAGG | 1868 |
| JAG1.1 | NM_000214 | NM_000214.1 | JAG1 | 4190 | TGGCTTACACTGGCAATGG | 405 | GCATAGCTGTGAGATGCGG | 1137 | ACTCGATTTCCCAGCCAACCACAG | 1869 |
| K-ras.10 | NM_033360 | NM_033360.2 | KRAS | 3090 | GTCAAAATGGGAGGGACTA | 406 | CAGGACCACCACAGAGTGAG | 1138 | TGTATCTTGTTGAGCTATCCAAACTGCCC | 1870 |
| KCNJ15.1 | NM_002243 | NM_002243.3 | KCNJ15 | 6299 | GGACGTTCTACCTGCCTTGA | 407 | AGGCTCTGGAAACACTGGTC | 1139 | TCACTCCGCAGGTCAGGTGTCTTC | 1871 |
| KDR.6 | NM_002253 | NM_002253.1 | KDR | 463 | GAGGACGAAGGCTCTACAC | 408 | AAAAATGCCTCCACTTTTGC | 1140 | CAGGCATGCAGTGTTCTTGGCTGT | 1872 |
| Ki-67.2 | NM_002417 | NM_002417.1 | MKI67 | 145 | CGGACTTTGGGTGCGACTT | 409 | TTACAACTCTTCCACTGGGACGAT | 1141 | CCACTTGTCGAACCACCGCTCGT | 1873 |
| KIAA1303 raptor. | NM_020761 | NM_020761.2 | RPTOR | 6300 | ACTACAGCGGGAGCAGGAG | 410 | GGCATCTGAGCAAGAGGGT | 1142 | TGGAGGTAGCTGCAATCAACCAA | 1874 |
| KIF1A.1 | NM_004321 | NM_004321.4 | KIF1A | 4015 | CTCCTACTGGTCGCACACC | 411 | TCCCGGTACACCTGCTTC | 1143 | CCTGAGGACATCAACTACCGCTCG | 1875 |
| Kitlng.4 | NM_000899 | NM_000899.1 | KITLG | 68 | GTCCCCGGGATGGATGTT | 412 | GATCAGTTCAAGCTGTCTGACAATTG | 1144 | CATCTCGCTTATCCAACAATGACTTGGCA | 1876 |
| KL.1 | NM_004795 | NM_004795.2 | KL | 6191 | GAGGTCCTGTCTAAACCCTGTG | 413 | CTATGTGCAAGGCCCTCAA | 1145 | CCTGAGGGATCGTCTCACTGGCA | 1877 |
| KLK3.1 | NM_001648 | NM_001648.2 | KLK3 | 4172 | CCAAGCTTACCACCTGCAC | 414 | AGGGTGAGGAAGACAACCG | 1146 | ACCCACATGTGACACAGCTCTCC | 1878 |
| KLRK1.2 | NM_007360 | NM_007360.1 | KLRK1 | 3805 | TGAGAGCCAGGCTTCTTGTA | 415 | ATCCTGTCCTCTTTGCTGT | 1147 | TGTCTCAAAATGCCAGCCTTCTGAA | 1879 |

TABLE A-continued

| Gene | Accession Num | Sequence_ID | Official Symbol | Gene Version ID | F Primer Seq | SEQ ID NO. | R Primer Seq | SEQ ID NO. | Probe Seq | SEQ ID NO. |
|---|---|---|---|---|---|---|---|---|---|---|
| KRT19.3 | NM_002276 | NM_002276.1 | KRT19 | 521 | TGAGCGGCAGAAT CAGGAGTA | 416 | TGCGGTAGGTGG CAATCTC | 1148 | CTCATGGACATCAAG TCGCGGCTG | 1880 |
| KRT5.3 | NM_000424 | NM_000424.2 | KRT5 | 58 | TCAGTGAGAAGG AGTTGGA | 417 | TGCCATATCCAG AGGAAACA | 1149 | CCAGTCAACATCTCT GTTGTCACAAGCA | 1881 |
| KRT7.1 | NM_005556 | NM_005556.3 | KRT7 | 4016 | TTCAGAGATGAACC GGGC | 418 | ACTTGGCACGCT GGTTCT | 1150 | ATGTTGTCGATTCA GCCTGCAGC | 1882 |
| L1CAM.1 | NM_000425 | NM_000425.2 | L1CAM | 4096 | CTTGCTGGCCAATG CCTA | 419 | TGATTGTCCGCA GTCAGG | 1151 | ATTACGTTGTCCAG CTGCCAGCC | 1883 |
| LAMA3.1 | NM_000227 | NM_000227.2 | LAMA3 | 2529 | CAGATGAGGCACA TGGAGAC | 420 | TTGAAATGGCAG AACGGTAG | 1152 | CTGATTCCTCAGGTC CTTGGCCTG | 1884 |
| LAMA4.1 | NM_002290 | NM_002290.3 | LAMA4 | 5990 | GATGCACTGCGT TAGCAG | 421 | CAGAGGATACGC TCAGCACC | 1153 | CTCTCCATCGAGGAA GGCAAATCC | 1885 |
| LAMB1.1 | NM_002291 | NM_002291.1 | LAMB1 | 3894 | CAAGGAGACTGGG AGGTGTC | 422 | CGGCAGAACTGA CAGTGTTC | 1154 | CAAGTGCCTGTACCA CACGAAGG | 1886 |
| LAMB3.1 | NM_000228 | NM_000228.1 | LAMB3 | 2530 | ACTGACCAAGCCT GAGACCT | 423 | GTCACACTTGCA GCATTTCA | 1155 | CCACTCGCCATACTG GGTGCAGT | 1887 |
| LAMC2.2 | NM_005562 | NM_005562.1 | LAMC2 | 997 | ACTCAAGCGGAAAT TGAAGCA | 424 | ACTCCCTGAAGC CGAGACACT | 1156 | AGGTCTTATCAGCAC AGTTCCGCCTCC | 1888 |
| LAPTM5.1 | NM_006762 | NM_006762.1 | LAPTM5 | 4017 | TGCTGGACTTCTGC CTGAG | 425 | TGAGATAGGTGG GCACTTCC | 1157 | TCCTGACCCTCTGCA GCTCCTACA | 1889 |
| LDB1.2 | NM_003893 | NM_003893.4 | LDB1 | 6720 | AACACCCAGTTTGA CGCAG | 426 | CCAGTGCAGGG GAGTGT | 1158 | AAAGCTGTCCTCGTC GTCAATGCC | 1890 |
| LDB2.1 | NM_001290 | NM_001290.2 | LDB2 | 3871 | ATCACCGTGGACT GCGAC | 427 | TACCTTGGTAAA CATGGGCTTC | 1159 | AGTGTACCATGGTCA CCCAGCACG | 1891 |
| LDHA.2 | NM_005566 | NM_005566.1 | LDHA | 3935 | AGGCTACACATCCT GGGCTA | 428 | CCCGCCTAAGAT TCTTCATT | 1160 | TCTGCCAAATCTGCT ACAGAGAGTCCA | 1892 |
| LGALS1.1 | NM_002305 | NM_002305.3 | LGALS1 | 6305 | GGGTGGAGTCTTC TGACAGC | 429 | AGACCACAAGCC ATGATTGA | 1161 | CCCGGGAACATCCT CCTGGAC | 1893 |
| LGALS3.1 | NM_002306 | NM_002306.1 | LGALS3 | 2371 | AGCGGAAAATGC AGACAAT | 430 | CTTGAGGGTTTG GGTTTCCA | 1162 | ACCCAGATAACGCAT CATGAGCGA | 1894 |
| LGALS9.1 | NM_009587 | NM_009587.2 | LGALS9 | 5458 | AGTACTTCCACCGC GTGC | 431 | GACAGCTGCACA GAGCCAT | 1163 | CTTCCACCGTGTGG ACACCATCTC | 1895 |
| LIMK1.1 | NM_016735 | NM_016735.1 | LIMK1 | 3888 | GCTTCAGGTGTTGT GACTGC | 432 | AAGAGCTGCCCA TCCTTCTC | 1164 | TGCTCCCTGTCGC ACCAGTACTA | 1896 |

TABLE A-continued

| Gene | Accession Num | Sequence_ID | Official Symbol | Gene Version ID | F Primer Seq | SEQ ID NO. | R Primer Seq | SEQ ID NO. | Probe Seq | SEQ ID NO. |
|---|---|---|---|---|---|---|---|---|---|---|
| LMNB1.1 | NM_005573 | NM_005573.1 | LMNB1 | 1708 | TGCAAACGCTGGTGTCACA | 433 | CCCCACGAGTTCTGTTCTTC | 1165 | CAGCCCCCCAACTGACCTCATC | 1897 |
| LMO2.1 | NM_005574 | NM_005574.2 | LMO2 | 5346 | GGCTGCCAGCAGAACATC | 434 | CTCAGGCAGTCCTCGTGC | 1166 | CGCTACTTCCTGAAGGCCATCGAC | 1898 |
| LOX.1 | NM_002317 | NM_002317.3 | LOX | 3394 | CCAATGGGAGAACAACGG | 435 | CGCTGAGGCTGGTACTGTG | 1167 | CAGGCTCAGCAAGCTGAACACCTG | 1899 |
| LRP2.1 | NM_004525 | NM_004525.1 | LRP2 | 4112 | GGCTGTAGACTGGGTTTCCA | 436 | GAGACAAGAGGCCATCCAG | 1168 | CGGGCATCCAACCAGTAGAGCTTT | 1900 |
| LRRC2.1 | NM_024512 | NM_024512.2 | LRRC2 | 6315 | CCAGTGTCCCAATCTGTGTC | 437 | GGTCAGGTTATTGCTGCTGA | 1169 | CCACTGCAAATTCGACATCCGC | 1901 |
| LTF.1 | NM_002343 | NM_002343.2 | LTF | 6269 | AACGGAAGCCTGTGACTGA | 438 | AGACACCACGGCATGATTC | 1170 | CTAGAAGCTGCCATCTTGCCATGG | 1902 |
| LYZ.1 | NM_000239 | NM_000239.1 | LYZ | 6268 | TTGCTGCAAGATAACATCGC | 439 | ACCCATGTCTAATGCCTTG | 1171 | CACGGACAACCCTCTTTGCACAAG | 1903 |
| MADH2.1 | NM_005901 | NM_005901.2 | SMAD2 | 2672 | GCTGCCTTTGGTAAGAACATGTC | 440 | ATCCCAGCAGTCTCTTCACAACT | 1172 | TCCATCTTGCCATTCACGCCGC | 1904 |
| MADH4.1 | NM_005359 | NM_005359.3 | SMAD4 | 2565 | GGACATTACTGCCTGTTCACA | 441 | ACCAATACTCAGGAGCAGGATGA | 1173 | TGCATTCCAGCCTCCCATTTCCA | 1905 |
| MAL.1 | NM_002371 | NM_002371.2 | MAL | 6194 | GTTGGGAGCTTGCTGTGTC | 442 | CACAAACAGGAGGTGACCCT | 1174 | ACCTCCAACTGCTGTGCTGTGC | 1906 |
| MAL2.1 | NM_052886 | NM_052886.1 | MAL2 | 5113 | CCTTCGTCTGCCTGGAGAT | 443 | GGAACATTGGAGGAGGCAA | 1175 | CAAAATCCAGACAAGACCCCGAA | 1907 |
| MAP2K1.1 | NM_002755 | NM_002755.2 | MAP2K1 | 2674 | GCCTTTCTTACCCAGAAGCAGAA | 444 | CAGCCCCCAGCTCACTGAT | 1176 | TCTCAAAGTCGTCATCCTTCAGTTCTCCCA | 1908 |
| MAP2K3.1 | NM_002756 | NM_002756.2 | MAP2K3 | 4372 | GCCCTCCAATGTCCTTATCA | 445 | GTAGCCACTGATGCCAAAGTC | 1177 | CACATCTTCACATGGCCCTCCTG | 1909 |
| MAP4.1 | NM_002375 | NM_002375.2 | MAP4 | 2066 | GCCGGTCAGGCACACAAG | 446 | GCAGCATACACACAACAAAATGG | 1178 | ACCAACCAGTCCACGCTCCAAGGG | 1910 |
| MARCKS.1 | NM_002356 | NM_002356.4 | MARCKS | 4021 | CCCCTCTTGGATCTGTTGAG | 447 | CGGTCTTGGAGAACTGGG | 1179 | CCCATGCTGGCTTCTTCAACAAAG | 1911 |
| Maspin.2 | NM_002639 | NM_002639.1 | SERPINB5 | 362 | CAGATGGCCACTTTGAGAACATT | 448 | GGCAGCATTAACCACAAGGATT | 1180 | AGCTGACAACAGTGTGAACGACCAGACC | 1912 |
| MCAM.1 | NM_006500 | NM_006500.2 | MCAM | 3972 | CGAGTTCCAGTGGCTGAGA | 449 | TGCAACTGAAGCACAGGC | 1181 | CTTTCCAGCACCTGGCCTGTCTCT | 1913 |

TABLE A-continued

| Gene | Accession Num | Sequence_ID | Official Symbol | Gene Version ID | F Primer Seq | SEQ ID NO. | R Primer Seq | SEQ ID NO. | Probe Seq | SEQ ID NO. |
|---|---|---|---|---|---|---|---|---|---|---|
| MCM2.2 | NM_004526 | NM_004526.1 | MCM2 | 580 | GACTTTTGCCCGCTACCTTTC | 450 | GCCACTAACTGCTTCAGTATGAAGAG | 1182 | ACAGCTCATTGTTGTCACGCCGGA | 1914 |
| MCM3.3 | NM_002388 | NM_002388.2 | MCM3 | 524 | GGAGAACAATCCCCTTGAGA | 451 | ATCTCCTGGATGGTGATGGT | 1183 | TGGCCTTTCTGTCTACAAGGATCACCA | 1915 |
| MCM6.3 | NM_005915 | NM_005915.2 | MCM6 | 614 | TGATGGTCCTATGTGTCACATTCA | 452 | TGGGACAGGAAACACACCAA | 1184 | CAGGTTTCATACCAACACAGGCTTCAGCAC | 1916 |
| MCP1.1 | NM_002982 | NM_002982.1 | CCL2 | 700 | CGCTCAGCCAGATGCAATC | 453 | GCACTGAGATCTTCCTATTGGTGAA | 1185 | TGCCCCAGTCACCTGCTGTTA | 1917 |
| MDH2.1 | NM_005918 | NM_005918.2 | MDH2 | 2849 | CCAACACCTTTGTTGCAGAG | 454 | CAATGACAGGGACGTTGACT | 1186 | CGAGCTGGATCCAAACCCTTCAG | 1918 |
| MDK.1 | NM_002391 | NM_002391.2 | MDK | 3231 | GGAGCCGACTGCAAGTACA | 455 | GACTTTGGTGCCTGTGCC | 1187 | ATCACACGCACCCCAGTTCTCAAA | 1919 |
| MDM2.1 | NM_002392 | NM_002392.1 | MDM2 | 359 | CTACAGGGACGCCATCGAA | 456 | ATCCAACCAATCACCTGAATGTT | 1188 | CTTACACCAGCATCAAGATCCGG | 1920 |
| MGMT.1 | NM_002412 | NM_002412.1 | MGMT | 689 | GTGAAATGAAACGCACCACA | 457 | GACCCTGCTCACAACCAGAC | 1189 | CAGCCCTTTGGGAAGCTGG | 1921 |
| mGST1.2 | NM_020300 | NM_020300.2 | MGST1 | 806 | ACGGATCTACCACACCATTGC | 458 | TCCATATCCAACAAAAAACTCAAAG | 1190 | TTTGACACCCCTTCCCCAGCCA | 1922 |
| MICA.1 | NM_000247 | NM_000247.1 | MICA | 5449 | ATGGTGAATGTCACCCGC | 459 | AAGCCAGAAGCCCTGCAT | 1191 | CGAGCCTCAGAGGGCAACATTAC | 1923 |
| MIF.2 | NM_002415 | NM_002415.1 | MIF | 3907 | CCGGACCAGGGTCTACATCA | 460 | GGTGGAGTTGTTCCAGCC | 1192 | CTATTACGACATGAACGCGCCAA | 1924 |
| MMP1.1 | NM_002421 | NM_002421.2 | MMP1 | 2167 | GGGAGATCATCGGGACAACTC | 461 | GGGCCTGTTGAAAAGCAT | 1193 | AGCAAGATTTCCTCCAGGTCCATCAAAAGG | 1925 |
| MMP10.1 | NM_002425 | NM_002425.1 | MMP10 | 4920 | TGTACCCACTCTACAACTCATTCACA | 462 | TGAATGCCATTCACATCATCTTG | 1194 | AGCTCGCCCAGTTCCGCCTTTC | 1926 |
| MMP14.1 | NM_004995 | NM_004995.2 | MMP14 | 4022 | GCTGTGGAGCTCTCAGGAA | 463 | AGCAAGGACAGGGACCAA | 1195 | CCTGAGGAGGCACACTTGCTCCT | 1927 |
| MMP2.2 | NM_004530 | NM_004530.1 | MMP2 | 672 | CCATGATGGAGAGGCAGACA | 464 | GGAGTCCGTCCTTACCGTCAA | 1196 | CTGGGAGCATGGCGATGATACCC | 1928 |
| MMP7.1 | NM_002423 | NM_002423.2 | MMP7 | 2647 | GGATGTAGCAGTCTAGGGATTAACT | 465 | GGAATGTCCCATACCCAAAGAA | 1197 | CCTGTATGCTGCAACTCATGAACTTGGC | 1929 |

TABLE A-continued

| Gene | Accession Num | Sequence_ID | Official Symbol | Gene Version ID | F Primer Seq | SEQ ID NO. | R Primer Seq | SEQ ID NO. | Probe Seq | SEQ ID NO. |
|---|---|---|---|---|---|---|---|---|---|---|
| MMP9.1 | NM_004994 | NM_004994.1 | MMP9 | 304 | GAGAACCAATCTCACCGACA | 466 | CACCCGAGTGTAACCATAGC | 1198 | ACAGGTATTCCTCTGCCAGCTGCC | 1930 |
| MRP1.1 | NM_004996 | NM_004996.2 | ABCC1 | 15 | TCATGGTGCCCGTCAATG | 467 | CGATTGTCTTTGCTCTTCATGTG | 1199 | ACCTGATACGTCTTGGTCTTCATCGCCAT | 1931 |
| MRP2.3 | NM_000392 | NM_000392.1 | ABCC2 | 55 | AGGGGATGACTTGGACACAT | 468 | AAAACTGCATGGCTTTGTCA | 1200 | CTGCCATTCGACATGACTCAATTT | 1932 |
| MRP3.1 | NM_003786 | NM_003786.2 | ABCC3 | 8 | TCATCCTGGCGATCTACTTCCT | 469 | CCGTTGAGTGGAATCAGCAA | 1201 | TCTGTCCTGGCTGGAGTCGCTTTCAT | 1933 |
| MRP4.2 | NM_005845 | NM_005845.3 | ABCC4 | 6057 | AGCGCCTGGAATCTACAACT | 470 | AGAGCCCCTGAGAGAAGAT | 1202 | CGGAGTCCAGTGTTTTCCCACTTA | 1934 |
| MSH2.3 | NM_000251 | NM_000251.1 | MSH2 | 2127 | GATGCAGAATTGAGGCAGAC | 471 | TCTTGGCAAGTCGGTTAAGA | 1203 | CAAGAAGATTTACTTCGTCGATTCCCAGA | 1935 |
| MSH3.2 | NM_002439 | NM_002439.1 | MSH3 | 2132 | TGATTACCATCATGGCTCAGA | 472 | CTTGTGAAAATGCCATCCAC | 1204 | TCCCAATTGTCGCTTCTTCTGCAG | 1936 |
| MSH6.3 | NM_000179 | NM_000179.1 | MSH6 | 2136 | TCTATTGGGGATTGGTAGG | 473 | CAAATTGCGAGTGGTGAAAT | 1205 | CCGTTACCAGCTGGAAATTCCTGAGA | 1937 |
| MT1B.1 | NM_005947 | NM_005947.1 | MT1B | 5355 | GTGGGCTGTGCCAAGTGT | 474 | ACAGCAGGGCACTTCTC | 1206 | ATGAGCCTTTGCAGACACAGCCCT | 1938 |
| MT1G.1 | NM_005950 | NM_005950.1 | MT1G | 6333 | GTGCACCCACTGCCTCTT | 475 | AGCAGTTGGGGTCCATTG | 1207 | CCCGAGGCGAGACTAGAGTTCCC | 1939 |
| MT1H.1 | NM_005951 | NM_005951.2 | MT1H | 6332 | CGTGTTCCACTGCCTCTTC | 476 | AGCAGTTGGGGTCCATTG | 1208 | CCGAGGTGAGACTGGAGTTCCCA | 1940 |
| MT1X.1 | NM_005952 | NM_005952.2 | MT1X | 3897 | CTCCTGCAAATGCAAAGAGTG | 477 | ACTTGGCACAGCCCACAG | 1209 | CACCTCCTGCAAGAAGAGCTGCTG | 1941 |
| MUC1.2 | NM_002456 | NM_002456.1 | MUC1 | 335 | GGCCAGGATCTGTGGTGGTA | 478 | CTCCACGTCGTGGACATTGA | 1210 | CTCTGGCCTTCCGAGAAGGTACC | 1942 |
| MVP.1 | NM_017458 | NM_017458.1 | MVP | 30 | ACGAGAACGAGGGCATCTATGT | 479 | GCATGTAGGTGCTTCCAATCAC | 1211 | CGCACCTTTCCGGTCTTGACATCCT | 1943 |
| MX1.1 | NM_002462 | NM_002462.2 | MX1 | 2706 | GAAGGAATGGGAATCAGTCATGA | 480 | GTCTATTAGAGTCAGATCCGGGACAT | 1212 | TCACCCTGGAGATCAGCTCCCGA | 1944 |
| MYBL2.1 | NM_002466 | NM_002466.1 | MYBL2 | 1137 | GCCGAGATCGCCAAGATG | 481 | CTTTTGATGGTAGAGTTCCAGTGATTC | 1213 | CAGCATTGTCTGTCCTCCCTGGCA | 1945 |

TABLE A-continued

| Gene | Accession Num | Sequence_ID | Official Symbol | Gene Version ID | F Primer Seq | SEQ ID NO. | R Primer Seq | SEQ ID NO. | Probe Seq | SEQ ID NO. |
|---|---|---|---|---|---|---|---|---|---|---|
| MYH11.1 | NM_002474 | NM_002474.1 | MYH11 | 1734 | CGGTACTTCTCAGG GCTAATATATACG | 482 | CCGAGTAGATGG GCAGGTGTT | 1214 | CTTTTCTGCGTGTG GTCAACCCTA | 1946 |
| MYRIP.2 | NM_015460 | NM_015460.1 | MYRIP | 1704 | CCTTCACCTTCCTC GTCAAC | 483 | AGCAGCTCTTGC AGACATTG | 1215 | ATTTGCAATCTCCAC ACTGGCGCT | 1947 |
| NBN.1 | NM_002485 | NM_002485.4 | NBN | 4121 | GCATCTACTTGCCA GAACCAA | 484 | TCCCCTTGCAGCT GGAGTT | 1216 | CTTCCAAGTTCTGGC TGCTTGCAG | 1948 |
| NCF1.1 | NM_000265 | NM_000265.2 | NCF1 | 4676 | GACACCTTCATCCG TCACAT | 485 | ATAGTGTGGCT GGGTACG | 1217 | AAGCGCTTCTCAAAG CCCAGCAG | 1949 |
| NFAT5.1 | NM_006599 | NM_006599.2 | NFAT5 | 3071 | CTGAACCCCTCTCC TGGTC | 486 | AGGAAACCATGG CGAGGT | 1218 | CGAGAATCAGTCCC CGTGGAGTTC | 1950 |
| NFATC2.1 | NM_173091 | NM_173091.2 | NFATC2 | 5123 | CAGTCAAGGTCAG AGGCTGAG | 487 | CTTTGGCTCGTG GCATTC | 1219 | CGGGTTCCTACCCC ACAGTCATTC | 1951 |
| NFKBp50.3 | NM_003998 | NM_003998.1 | NFKB1 | 3439 | CAGACCAAGGAGA TGGACCT | 488 | AGCTGCCAGTGC TATCCG | 1220 | AAGCTGTAAACATGA GCCCACCA | 1952 |
| NFKBp65.3 | NM_021975 | NM_021975.1 | RELA | 39 | CTGCCGGGATGGC TTCTAT | 489 | CCAGGTTCTGGA AACTGTGGAT | 1221 | CTGAGCTCTGCCCG GACCGCT | 1953 |
| NFX1.1 | NM_002504 | NM_002504.3 | NFX1 | 4025 | CCCTGCCATACCA GCTCA | 490 | CGTCCACATTCA CACTGTAGC | 1222 | CCTGCCCTGTGACT GCTTGTAAAGC | 1954 |
| NME2.1 | NM_002512 | NM_002512.2 | NME2 | 3899 | ATGCTTGGGGAGA CCAATC | 491 | CTGAATGCAGAA GTCCCCAC | 1223 | AGCAGATTCAAAGCC AGGCACCAT | 1955 |
| NNMT.1 | NM_006169 | NM_006169.2 | NNMT | 5101 | CCTAGGGCAGGGA TGGAG | 492 | CTAGTCCAGCCA AACATCCC | 1224 | CCCTCTCCTCATGCC CAGACTCTC | 1956 |
| NOL3.1 | NM_003946 | NM_003946.3 | NOL3 | 6307 | CAGCCTTGGGAAG TGAGACT | 493 | ATGATGTGTGTG GCCTTTGT | 1225 | CTCAAGGTCCCTTTC TGCTCCCT | 1957 |
| NOS2A.3 | NM_000625 | NM_000625.3 | NOS2 | 6509 | GGGTCCATTATGAC TCCCAA | 494 | GCTCATCTGGAG GGGTAGG | 1226 | TGTCCCTGGGTCCT CTGGTCAAAC | 1958 |
| NOS3.1 | NM_000603 | NM_000603.2 | NOS3 | 2624 | ATCTCCGCCTCGCT CATG | 495 | TCGGAGCCATAC AGGATTGTC | 1227 | TTCACTCGCTTCGCC ATCACCG | 1959 |
| NOTCH1.1 | NM_017617 | NM_017617.2 | NOTCH1 | 2403 | CGGGTCCACAGT TTGAATG | 496 | GTTGTATTGGTT CGGCACCAT | 1228 | CCGCTCTGCAGCCG GGACA | 1960 |
| NOTCH2.1 | NM_024408 | NM_024408.2 | NOTCH2 | 2406 | CACTTCCCTGCTGG GATTAT | 497 | AGTTGTCAAACA GGCACTCG | 1229 | CCGTGTTGCACAGC TCATCACACT | 1961 |
| NOTCH3.1 | NM_000435 | NM_000435.2 | NOTCH3 | 6464 | TGTGGACGAGTGT GCTGG | 498 | ACTCCCCTGCCAG GTTGGT | 1230 | ACCCTGTGCCCCTC ATGGTATCTG | 1962 |

TABLE A-continued

| Gene | Accession Num | Sequence_ID | Official Symbol | Gene Version ID | F Primer Seq | SEQ ID NO. | R Primer Seq | SEQ ID NO. | Probe Seq | SEQ ID NO. |
|---|---|---|---|---|---|---|---|---|---|---|
| NPD009 (ABAT $$ | NM_020686 | NM_020686.2 | ABAT | 1707 | GGCTGTGGCTGAGGCTGTAG | 499 | GGAGCATTCGAGGTCAAATCA | 1231 | TTCCCAGAGTGTCTCACTTCCAGCAGAG | 1963 |
| NPM1.2 | NM_002520 | NM_002520.2 | NPM1 | 2328 | AATGTTGTCCAGGTTCTATTGC | 500 | CAAGCAAAGGGTGGAGTTC | 1232 | AACAGGCATTTTGAACAACACATTCTTG | 1964 |
| NPPB.1 | NM_002521 | NM_002521.2 | NPPB | 6196 | GACACCTGCTTCTGATTCCAC | 501 | TGAGTCACTTCAAAGGCGG | 1233 | AGGGGCTTTTTCCTCAACCCTGTG | 1965 |
| NPR1.1 | NM_000906 | NM_000906.2 | NPR1 | 6197 | ACATTCTGCAGTCCCCTG | 502 | CACACAAGCAGCTTCCA | 1234 | CCTTCAGAACCCTCATGCTCCTGG | 1966 |
| NPY1R.1 | NM_000909 | NM_000909.4 | NPY1R | 4513 | GGATCTTCCCCACTCTGCT | 503 | TTGTCTTTTTCGCTCCTGC | 1235 | CCTTCCATTCCCACCCTTCCTTCT | 1967 |
| NRG1.3 | NM_013957 | NM_013957.1 | NRG1 | 410 | CGAGACTCTCCTCATAGTGAAAGGTAT | 504 | CTTGGCGTGTGGAAATCTACAG | 1236 | ATGACCACCCCGGCTCGTATGTCA | 1968 |
| NUDT1.1 | NM_002452 | NM_002452.3 | NUDT1 | 4564 | ACTGGTTTCCACTCCTGCTT | 505 | GTCCAGGATGGTGTCCTGA | 1237 | CCACGGGTACTTCAAGTTCCAGGG | 1969 |
| OGG1.1 | NM_002542 | NM_002542.4 | OGG1 | 6198 | ACCAAGGTGGCTGACTGC | 506 | ATATGGACATCCACGGGC | 1238 | TCTGCCTGATGGCCCTAGACAAGC | 1970 |
| OPN, osteoponti$$ | NM_000582 | NM_000582.1 | SPP1 | 764 | CAACCGAAGTTTTCACTCCAGTT | 507 | CCTCAGTCCATAAACCACTATCA | 1239 | TCCCCACAGTAGACACATATGATGGCCG | 1971 |
| p21.3 | NM_000389 | NM_000389.1 | CDKN1A | 33 | TGGAGACTCTCAGGGTCGAAA | 508 | GGCGTTTGGAGTGGTAGAAATC | 1240 | CGGGGCGAGACCAGCATGAC | 1972 |
| p27.3 | NM_004064 | NM_004064.1 | CDKN1B | 38 | CGGTGACCACGAAGAGTTAA | 509 | GGCTCGCTCTTCCATGTC | 1241 | CCGGGACTTGGAGAAGCACTGCA | 1973 |
| P53.2 | NM_000546 | NM_000546.2 | TP53 | 59 | CTTTGAACCCTTGCTTGCAA | 510 | CCCGGGACAAAGCAAATG | 1242 | AAGTCCTGGGTGCTTCTGACGCACA | 1974 |
| PAH.1 | NM_000277 | NM_000277.1 | PAH | 6199 | TGGCTGATTCCATTAACAGTGA | 511 | CACATTCTGTCCATGGCTTTAC | 1243 | ATCCTTTGCAGTGCCCTCCAGAAA | 1975 |
| PAI1.3 | NM_000602 | NM_000602.1 | SERPINE1 | 36 | CCGCAACGTGGTTTCTCA | 512 | TGCTGGGTTTCTCCTCCTGTT | 1244 | CTCGTGTTGGCCATGCTCCAG | 1976 |
| Pak1.2 | NM_002576 | NM_002576.3 | PAK1 | 3421 | GAGCTGTGGGTTGTTATGGA | 513 | CCATGCAAGTTTCTGTCACC | 1245 | ACATCTGTCAAGGAGCCTCCAGCC | 1977 |
| PARD6A.1 | NM_016948 | NM_016948.2 | PARD6A | 4514 | GATCCTCGAGGTCAATGGC | 514 | ACCATCATGTCCGTCACTTG | 1246 | TCCAAGGTCTTCCCGGCTACTTCA | 1978 |
| PBOV1.1 | NM_021635 | NM_021635.1 | PBOV1 | 3936 | GCAAAGCCTTTCCAGAAAAA | 515 | GGCTGGGCTTAAACAGTCAT | 1247 | TGGTAGCAGAATTGCCTTTTCAACCA | 1979 |

TABLE A-continued

| Gene | Accession Num | Sequence_ID | Official Symbol | Gene Version ID | F Primer Seq | SEQ ID NO. | R Primer Seq | SEQ ID NO. | Probe Seq | SEQ ID NO. |
|---|---|---|---|---|---|---|---|---|---|---|
| PCCA.1 | NM_000282 | NM_000282.2 | PCCA | 6250 | GGTGAAATCTGCACTGTCA | 516 | ATTCCAGCTCCACCAGCA | 1248 | TCCCTTCTCCAACTGTGTCTCCA | 1980 |
| PCK1.1 | NM_002591 | NM_002591.2 | PCK1 | 6251 | CTTAGCATGGCCCAGCAC | 517 | CTTCCGGAACCAGTTGACA | 1249 | CAGCCAAACTGCCCAAGATCTTCC | 1981 |
| PCNA.2 | NM_002592 | NM_002592.1 | PCNA | 148 | GAAGGTGTTGGAGGCACTCAAG | 518 | GGTTTACACCGCTGGAGCTAA | 1250 | ATCCAGCAGGCCTCGTTGATGAG | 1982 |
| PCSK6.1 | NM_002570 | NM_002570.3 | PCSK6 | 6282 | ACCTTGAGTAGCAGAGGCCC | 519 | GTTGCTGAGCCATTTCAC | 1251 | CACACCTTCCTCCAGAATGACCCC | 1983 |
| PDCD1.1 | NM_005018 | NM_005018.2 | PDCD1 | 6286 | GACAACGCCACCTTCACC | 520 | GGCTCATCGCGTACCAGT | 1252 | TCTCCAACACATCGGAGAGCTTCG | 1984 |
| PDE4DIP.1 | NM_014644 | NM_014644.4 | PDE4DIP | 6417 | GCTTCGTCTTGCTGTGAGAG | 521 | AGCTTCATTGGAGGGAGAGAG | 1253 | TCGCGCAGTCTCTCTAAGTCATGATCTC | 1985 |
| PDGFA.3 | NM_002607 | NM_002607.2 | PDGFA | 56 | TTGTTGGTGTGCCCTGGTG | 522 | TGGGTTCTGTCCAAACACTGG | 1254 | TGGTGGCGGTCACTCCCCTGC | 1986 |
| PDGFB.3 | NM_002608 | NM_002608.1 | PDGFB | 67 | ACTGAAGGAGACCCTTGGAG | 523 | TAAATAACCCTGCCCACACA | 1255 | TCTCCTGCCGATGCCCCTAGG | 1987 |
| PDGFC.3 | NM_016205 | NM_016205.1 | PDGFC | 29 | AGTTACTAAAAATACCACGAGGTCCTT | 524 | GTCGGTGAGTGATTTGTGCAA | 1256 | CCCTGACACGGTCTTTGGTCTCAACT | 1988 |
| PDGFD.2 | NM_025208 | NM_025208.2 | PDGFD | 31 | TATCGAGGCAGGTCATACCA | 525 | TAACGCTTGGCATCATCATT | 1257 | TCCAGGTCAACTTTTGACTTCCGGT | 1989 |
| PDGFRa.2 | NM_006206 | NM_006206.2 | PDGFRA | 24 | GGGAGTTTCAAGAGATGGA | 526 | CTTCAACCACCTTCCCAAAC | 1258 | CCCAAGACCCGACCAAGCACTAG | 1990 |
| PDGFRb.3 | NM_002609 | NM_002609.2 | PDGFRB | 464 | CCAGCTCTCCTTCCAGCTAC | 527 | GGGTGGCTCTCACTTAGCTC | 1259 | ATCAATGTCCCTGTCCGAGTGCTG | 1991 |
| PDZK1.1 | NM_002614 | NM_002614.3 | PDZK1 | 6319 | AATGACCTCCACCTTCAACC | 528 | CGCAGGAAGAAGCCATAGTT | 1260 | TGCCCTTCTTGCTTGGACAGTTTACA | 1992 |
| PDZK3.1 | NM_015022 | NM_015022.2 | | 3885 | GAGCTGAGAGCCTTGAGCAT | 529 | CTCGGCCCTGCTGAGTAA | 1261 | CTCGCTGCAGAGCTTGTCAAGGTC | 1993 |
| PF4.1 | NM_002619 | NM_002619.1 | PF4 | 6326 | GCAGTGCCTGTGTGTGAAG | 530 | GGCCTTGATCACCTCCAG | 1262 | TCCGTCCCAGGCACATCACC | 1994 |
| PFKP.1 | NM_002627 | NM_002627.3 | PFKP | 6252 | AGCTGATGCCGCATACATT | 531 | GGTGCTCCACGTTGGACT | 1263 | CAGATCCCTGATGTCGAAGGGCTC | 1995 |
| PFN2.1 | NM_053024 | NM_053024.1 | PFN2 | 3426 | TCTATACGTCGATGGTGACTGC | 532 | GCCGACAGCCACATTGTAT | 1264 | CTCCCCACCTTGACTCTTTGTCCG | 1996 |

TABLE A-continued

| Gene | Accession Num | Sequence_ID | Official Symbol | Gene Version ID | F Primer Seq | SEQ ID NO. | R Primer Seq | SEQ ID NO. | Probe Seq | SEQ ID NO. |
|---|---|---|---|---|---|---|---|---|---|---|
| PGF.1 | NM_002632 | NM_002632.4 | PGF | 4026 | GTGGTTTTCCCTCGGAGC | 533 | AGCAAGGGAACAGCTCAT | 1265 | ATCTTCTCAGACGTCCCGAGCCAG | 1997 |
| PI3K.2 | NM_002646 | NM_002646.2 | PIK3C2B | 368 | TGCTACCTGGACAGCCCG | 534 | AGCCGTCCTTCAGTAACCA | 1266 | TCCTCCTGAAACGAGCTGTGTCTGACTT | 1998 |
| PI3KC2A.1 | NM_002645 | NM_002645.2 | PIK3C2A | 6064 | ATACCAATCACCGCACAAAC | 535 | CACACTAGCATTTTCTCCGCATA | 1267 | TGTCGTGTGACTGGACTTAACAAATAGCCT | 1999 |
| PIK3CA.1 | NM_006218 | NM_006218.1 | PIK3CA | 2962 | GTGATTGAAGAGCATGCCAA | 536 | GTCCTGCGTGGGAATAGC | 1268 | TCCTGCTTCTCCGGATACAGACCA | 2000 |
| PLA2G4C.1 | NM_003706 | NM_003706.1 | PLA2G4C | 6249 | CCCTTTCCCCAAGTAGAAGAG | 537 | AGGATGTAGCAGCTGGCG | 1269 | CCTTGGACCACAAATCCAGCTCAG | 2001 |
| PLAT.1 | NM_033011 | NM_033011.2 | PLAT | 6459 | GATTTGCTGGGAAGTGCTGT | 538 | TAGCTGATGCCCTGGTCC | 1270 | TAGATACCAGGGCCACGTGCTACG | 2002 |
| PLAUR.3 | NM_002659 | NM_002659.1 | PLAUR | 708 | CCCATGCGATGCTCCTCTGAA | 539 | CCGGTGGCTACCAGACATTG | 1271 | CATTGACTGCCGAGGCCCATG | 2003 |
| PLG.1 | NM_000301 | NM_000301.1 | PLG | 6310 | GGCAAAATTTCCAAGACCAT | 540 | ATGTATCCATGAGCGTGTGG | 1272 | TGCCAGGCCTGGGACTCTCA | 2004 |
| PLN.1 | NM_002667 | NM_002667.2 | PLN | 3886 | TGATGCTTCTCTGAAGTTCTGC | 541 | CCTGTCTGCATGGGATGAC | 1273 | AGATCTGCAGCTTGCCACATCAGC | 2005 |
| PLOD2.1 | NM_000935 | NM_000935.2 | PLOD2 | 3820 | CAGGGAGGTGTTGCAAAT | 542 | TCTCCCAGGATGCATGAAG | 1274 | TCCAGCCTTTTCGTGGTGACTCAA | 2006 |
| PLP1.1 | NM_000533 | NM_000533.3 | PLP1 | 4027 | AGAACAGACTGCCTGAGGA | 543 | CAGAGGGCCATCTCAGGTT | 1275 | CACCATTAGCCACCAGCAGCTGCT | 2007 |
| PMP22.1 | NM_000304 | NM_000304.2 | PMP22 | 6254 | CCATCTACACGGTGAGGCA | 544 | TGTAGGCGAAACCGTAGGA | 1276 | AATCCGAGTTGAGATGCCACTCCG | 2008 |
| PPAP2B.1 | NM_003713 | NM_003713.3 | PPAP2B | 6457 | ACAAGCACCATCCCAGTGA | 545 | CACGAAGAAAACTATGCAGCAG | 1277 | ACCAGGGCTCCTTGAGCAAATCCT | 2009 |
| PPARG.3 | NM_005037 | NM_005037.3 | PPARG | 1086 | TGACTTTATGGAGCCCAAGTT | 546 | GCCAAGTGCTGTCATCTAA | 1278 | TTCCAGTGCATTGAACTTCACAGCA | 2010 |
| PPP1R3C.1 | NM_005398 | NM_005398.4 | PPP1R3C | 6320 | TTCCTTCCCTCTCAATCCAC | 547 | CACAGTTTCATCACCATC | 1279 | CCTTCCTCAACTTTTCCTTGCCCA | 2011 |
| PPP2CA.1 | NM_002715 | NM_002715.2 | PPP2CA | 3879 | GCAATCATGGAACTTGACGA | 548 | ATGTGGCTGCCTCTACG | 1280 | TTTCTTGCAGTTTGACCCAGCACC | 2012 |
| PRCC.1 | NM_005973 | NM_005973.4 | PRCC | 6002 | GAGGAAGAGGAGGCGGTG | 549 | CAGGGAGAGAAGCGAACAA | 1281 | CTACATCTGGGCCCGCTTTAGGG | 2013 |

TABLE A-continued

| Gene | Accession Num | Sequence_ID | Official Symbol | Gene Version ID | F Primer Seq | SEQ ID NO. | R Primer Seq | SEQ ID NO. | Probe Seq | SEQ ID NO. |
|---|---|---|---|---|---|---|---|---|---|---|
| PRKCA.1 | NM_002737 | NM_002737.1 | PRKCA | 2626 | CAAGCAATGCGTCATCAATGT | 550 | GTAAATCCGCCCCCTCTTCT | 1282 | CAGCCTCTGCGAATGGATCACACT | 2014 |
| PRKCB1.1 | NM_002738 | NM_002738.5 | PRKCB | 3739 | GACCCAGCTCCACTCCTG | 551 | CCCATTCACGTACTCCATCA | 1283 | CCAGACCATGGACCGCTGTACTT | 2015 |
| PRKCD.2 | NM_006254 | NM_006254.1 | PRKCD | 626 | CTGACACTTGCCGCAGAGAA | 552 | AGGTGGTCCTTGGTCTGGAA | 1284 | CCCTTTCTCACCCACCTCATCTGCAC | 2016 |
| PRKCH.1 | NM_006255 | NM_006255.3 | PRKCH | 4370 | CTCCACCTATGAGCGTCTGTC | 553 | CACACTTTCCCTCCTTTTGG | 1285 | TCCTGTTAACATCCCAAGCCCACA | 2017 |
| PRO2000.3 | NM_014109 | NM_014109.2 | ATAD2 | 1666 | ATTGGAAAAACCTCGTCACC | 554 | TCCGTATCTTGGTCTTGCAG | 1286 | CCCAACATATTTTATAGTGGCCCAGC | 2018 |
| PROM1.1 | NM_006017 | NM_006017.1 | PROM1 | 4516 | CTATGACAGGCATGCCACC | 555 | CTCCAACCATGAGGAAGACG | 1287 | ACCCGAGGCTGTGTCTCCAACAC | 2019 |
| PROM2.1 | NM_144707 | NM_144707.1 | PROM2 | 5108 | CTTCAGCGCATCCACTACC | 556 | CCATGCTGGTCTTCACCAC | 1288 | CTTCCTCGTTCAGATCCAGAGCC | 2020 |
| PRPS2.1 | NM_001039091 | NM_001039091$ | PRPS2 | 4694 | CACTGCCACCAAGATTCAGGT | 557 | ATTGTGTGTCCTTCGGATTG | 1289 | TTGACATTTCCATGATCTTGGCCG | 2021 |
| PRSS8.1 | NM_002773 | NM_002773.2 | PRSS8 | 4742 | GTACACTCTGGCCTCCAGCTA | 558 | CCACACGAGGCTGGAGTT | 1290 | TCCTGGATCCAAAGCAAGTGACA | 2022 |
| PSMA7.1 | NM_002792 | NM_002792.2 | PSMA7 | 6255 | GCCAAACTGCAGGATGAAAG | 559 | AGGCCATGCAGACGTTGT | 1291 | CCAAAGCACAGATCTTCCGCACTG | 2023 |
| PSMB8.1 | NM_148919 | NM_148919.3 | PSMB8 | 6461 | CAGTGCCTATCGGCCTAATC | 560 | TAAGCAATAGCCCTGCGG | 1292 | CAAGGTCATAGGCCTCTTCAGGGC | 2024 |
| PSMB9.1 | NM_148954 | NM_148954.2 | PSMB9 | 6462 | GGGGTGTCATCTACCTGGTC | 561 | CATTGCCCAAGATGACTCG | 1293 | TGGTCCACACCGGCAGCTGTAATA | 2025 |
| PTEN.2 | NM_000314 | NM_000314.1 | PTEN | 54 | TGGCTAAGTGAAGATGACAATCATG | 562 | TGCACATATCATTACACCAGTTCGT | 1294 | CCTTTCCAGCTTTACAGTGAATTGCTGCA | 2026 |
| PTGIS.1 | NM_000961 | NM_000961.3 | PTGIS | 5429 | CCACACTGGCATCTCCCT | 563 | GCCCATGGGATGAGAAACT | 1295 | CCTTCTCCAGGGACAGAAGCAGGA | 2027 |
| PTHR1.1 | NM_000316 | NM_000316.1 | PTH1R | 2375 | CGAGGTACAAGCTGAGATCAAGAA | 564 | GCGTGCTTTCGCTTGAA | 1296 | CCAGTGCCAGTGTCCAGCGGCT | 2028 |
| PTK2.1 | NM_005607 | NM_005607.3 | PTK2 | 2678 | GACCGGTCGAATGATAAGGT | 565 | CTGGACATCTCGATGACAGC | 1297 | ACCAGGCCCGTCACATTCTGTAC | 2029 |
| PTK2B.1 | NM_004103 | NM_004103.3 | PTK2B | 2883 | CAAGCCCAGCCGACCTAAG | 566 | GAACCTGAACTGCAGCTTTG | 1298 | CTCCGCAAACCAACCTCCTGGCT | 2030 |

TABLE A-continued

| Gene | Accession Num | Sequence_ID | Official Symbol | Gene Version ID | F Primer Seq | SEQ ID NO. | R Primer Seq | SEQ ID NO. | Probe Seq | SEQ ID NO. |
|---|---|---|---|---|---|---|---|---|---|---|
| PTN.1 | NM_002825 | NM_002825.5 | PTN | 3964 | CCTTCCAGTCCAAAAATCCC | 567 | CCCCTCTCTCCACTTTGGAT | 1299 | TTCCTCTGCTCTGGGGCTCTCTG | 2031 |
| PTPNS1.1 | NM_080792 | NM_080792.1 | SIRPA | 2896 | CTCCAGCTAGCACTAAGCAACATC | 568 | TTTCAAGATTGCACGTTTCACAT | 1300 | TCTCAGTAATTACAGGGTCCACAG | 2032 |
| PTPRB.1 | NM_002837 | NM_002837.2 | PTPRB | 3881 | GATATGCGGTGAGGAACAGC | 569 | CTGGCCACACCGTATAGTGA | 1301 | ATGCACACAAGACTCATCCGCCACT | 2033 |
| PTPRC.1 | NM_080921 | NM_080921.2 | PTPRC | 6450 | TGGCCCGTCAATGGAAGAG | 570 | GGACATCTTTTGTGCTGGTTG | 1302 | CAACATCTCCAAAAGCCCGAGTGC | 2034 |
| PTPRG.1 | NM_002841 | NM_002841.2 | PTPRG | 2682 | GGACAGCGACAAAGACTTGA | 571 | GGACTCGGAACAGGTAAAGG | 1303 | CACCATTAGCCATGTCTCACCCGA | 2035 |
| PTTG1.2 | NM_004219 | NM_004219.2 | PTTG1 | 1724 | GGCTACTCTGATCTATGTTGATAAGGAA | 572 | GCTTCAGCCCATCCTTAGCA | 1304 | CACACGGGTGCCTGGTTCTCCA | 2036 |
| PVALB.1 | NM_002854 | NM_002854.2 | PVALB | 4316 | AAACCAAGATGCTGATGGCT | 573 | CAGCCACCAGAGTGGAGAA | 1305 | TTTTGCCGTCCCCATCTTTGTCTC | 2037 |
| PXDN.1 | NM_012293 | NM_012293.1 | PXDN | 6257 | GCTGCTCAAGCTGAACCC | 574 | ACCCACGATCTTCCTGGTC | 1306 | ACTGGGACGGCGACACCATCTACT | 2038 |
| RAC1.3 | NM_006908 | NM_006908.3 | RAC1 | 2698 | TGTTGTAAATGTCTCAGCCCC | 575 | TTGAGCAAAGCGTACAAAGG | 1307 | CGTTCTTGGTCCTGTCCCTTGGA | 2039 |
| RAD51.1 | NM_002875 | NM_002875.2 | RAD51 | 3976 | AGACTACTCGGGTCGAGGTG | 576 | AGCATCCGCAGAAACCTG | 1308 | CTTTCAGCAGGCAGATGCACTTG | 2040 |
| RAF1.3 | NM_002880 | NM_002880.1 | RAF1 | 2130 | CGTCGTATGCGAGAGTCTGT | 577 | TGAAGGCGTGAGGTGTAGAA | 1309 | TCCAGGATGCCTGTTAGTTCTCAGCA | 2041 |
| RALBP1.1 | NM_006788 | NM_006788.2 | RALBP1 | 2105 | GGTGTCAGATATAAATGTGCAAATGC | 578 | TTCGATATTGCCAGCAGCTATAAA | 1310 | TGCTGTCCTGTCGGTCTCAGTACGTTCA | 2042 |
| RARB.2 | NM_016152 | NM_016152.2 | RARB | 687 | TGCCTGGACATCCTGATTCT | 579 | AAGGCCGTCTGAGAAAGTCA | 1311 | TGCACCAGTATACCCCAGAACAAGA | 2043 |
| RASSF1.1 | NM_007182 | NM_007182.4 | RASSF1 | 6658 | AGGGCACGTGAAGTCATTG | 580 | AAAGAGTGCAAACTTGCGG | 1312 | CACCACCAAGAACTTTCCGCACAG | 2044 |
| RB1.1 | NM_000321 | NM_000321.1 | RB1 | 956 | AGGAGCCCTTACAAGTTTCC | 581 | GGACTCTTTCAGGGGTGAAAT | 1313 | CCCTTACGGATTCCTGGAGGGAAC | 2045 |
| RBM35A.1 | NM_017697 | NM_017697.2 | ESRP1 | 5109 | TGGTTTTGAATCACCAGGG | 582 | CTCTGTCCGCAGACTTCATCT | 1314 | CGCCCATCAGGAGATGCCTTTATC | 2046 |
| REG4.1 | NM_032044 | NM_032044.2 | REG4 | 3226 | TGCTAACTCCTCCTGCACAGCC | 583 | TGCTAGGTTCCCCCTCTGAA | 1315 | TCCTCTTCCTTTCTGCTAGCCTGGC | 2047 |

TABLE A-continued

| Gene | Accession Num | Sequence_ID | Official Symbol | Gene Version ID | F Primer Seq | SEQ ID NO. | R Primer Seq | SEQ ID NO. | Probe Seq | SEQ ID NO. |
|---|---|---|---|---|---|---|---|---|---|---|
| RET.1 | NM_020630 | NM_020630.3 | RET | 5001 | GCCTGTGCAGTTCT TGTGC | 584 | GGAAGGGCAGA CCCTCAC | 1316 | AACATCAGCGTGGC CTACAGGCTC | 2048 |
| RGS1.1 | NM_002922 | NM_002922.3 | RGS1 | 6258 | TGCCCTGTAAAGCA GAAGAGAT | 585 | CTCGAGTGCGGA AGTCAATA | 1317 | AGCAGCATCTGAATG CACAAATGCT | 2049 |
| RGS5.1 | NM_003617 | NM_003617.1 | RGS5 | 2004 | TTCAAACGGAGGCT CCTAAAGAG | 586 | GAAGGTTCCACC AGTTCTTCA | 1318 | AATATTGACCACTTC ACTAGGACATCACA | 2050 |
| RHEB.2 | NM_005614 | NM_005614.3 | RHEB | 6609 | GATGATTGAGAACA GCCTTGC | 587 | GCTCCCAAGACT CTGACACA | 1319 | TGTCACTGTCCTAGA ACACCCTGGAGTT | 2051 |
| RhoB.1 | NM_004040 | NM_004040.2 | RHOB | 2951 | AAGCATGAACAGGA CTTGACC | 588 | CCTCCCCAAGTC AGTTGC | 1320 | CTTTCCAACCCCTGG GGAAGACAT | 2052 |
| rhoC.1 | NM_175744 | NM_175744.1 | RHOC | 773 | CCCGTTCGGTCTG AGGAA | 589 | GAGCACTCAAGG TAGCCAAAGG | 1321 | TCCGGTTCGCCATGT CCCG | 2053 |
| RIPK1.1 | NM_003804 | NM_003804.3 | RIPK1 | 6259 | AGTACCTTCAAGCC GGTCAC | 590 | AAGTCCCTGGGA ACTGTGC | 1322 | CAGCCACAGAACAG CCTGGTTCAC | 2054 |
| RND3.1 | NM_005168 | NM_005168.3 | RND3 | 5381 | TCGGAATTGGACTT GGGAG | 591 | CTGGTTACTCCC CTCAACA | 1323 | TTTTAAGCTGACTC CTACCGCG | 2055 |
| ROCK1.1 | NM_005406 | NM_005406.1 | ROCK1 | 2959 | TGTGCACATAGGAA TGAGCTC | 592 | GTTTAGCACGCA ATTGCTCA | 1324 | TCACTCTCTTTGCTG GCCAACTGC | 2056 |
| ROCK2.1 | NM_004850 | NM_004850.3 | ROCK2 | 2992 | GATCCGAGACCCT CGCTC | 593 | AGGACCAAGGAA TTTAAGCCA | 1325 | CCCATCAACGTGGA GAGCTTGCT | 2057 |
| RPLP1.1 | NM_213725 | NM_213725.1 | RPLP1 | 5478 | CAAGGTGCTCGGT CCTTC | 594 | GTCGCCGGATGA AGTGAG | 1326 | CCTCACCCCAACGCA GCCTTAGCT | 2058 |
| RPS23.1 | NM_001025 | NM_001025.1 | RPS23 | 3320 | GTTCTGGTTGCTG GATTTGG | 595 | CCTTAAAGCGGA CTCCAGG | 1327 | ATCACCAACAGCATG ACCTTTGCG | 2059 |
| RPS27A.1 | NM_002954 | NM_002954.3 | RPS27A | 6329 | CTTACGGGGAAGA CCATCAC | 596 | TCCTGGATCTTG GCCTTTAC | 1328 | TCGTATCCGAGGGTT CAACCTCG | 2060 |
| RPS6KA1.1 | NM_002953 | NM_002953.3 | RPS6KA1 | 3865 | GCTCATGGAGCTA GTGCCTC | 597 | CGGCTGAAGTCC AGTTCT | 1329 | ACCCGGAGAATGGA CAGACCTCAG | 2061 |
| RPS6KB1.3 | NM_003161 | NM_003161.1 | RPS6KB1 | 928 | GCTCATTATGAAAA ACATCCCAAAC | 598 | AAGAAACAGAAG TTGTCTGCTTT CT | 1330 | CACACCAACCAATAA TTTCGCATT | 2062 |
| RRM1.2 | NM_001033 | NM_001033.1 | RRM1 | 1000 | GGGCTACTGGCAG CTACATT | 599 | CTCTCAGCATCG GTACAAGG | 1331 | CATTGGAATTGCCAT TAGTCCCAGC | 2063 |

TABLE A-continued

| Gene | Accession Num | Sequence_ID | Official Symbol | Gene Version ID | F Primer Seq | SEQ ID NO. | R Primer Seq | SEQ ID NO. | Probe Seq | SEQ ID NO. |
|---|---|---|---|---|---|---|---|---|---|---|
| RRM2.1 | NM_001034 | NM_001034.1 | RRM2 | 2546 | CAGCGGGATTAAACAGTCCT | 600 | ATCTGCCTTGAAGCAGTGAG | 1332 | CCAGCACAGCCAGTTAAAGATGCA | 2064 |
| RUNX1.1 | NM_001754 | NM_001754.3 | RUNX1 | 6067 | AACAGAGACATTGCCAACCA | 601 | GTGATTTGCCCAGGAAAGTTT | 1333 | TTGGATCTGCTTGCTGTCCAAACC | 2065 |
| S100A1.1 | NM_006271 | NM_006271.1 | S100A1 | 2851 | TGGACAAGGTGATGAAGGAG | 602 | AGCACCACATACTCCTGGAA | 1334 | CCTCCCCGTCTCCATTCTCGTCTA | 2066 |
| S100A10.1 | NM_002966 | NM_002966.1 | S100A10 | 3579 | ACACCAAAAATGCCATCTCAA | 603 | TTTATCCCCAGCGAATTTGT | 1335 | CAGCCATGGAAACCATGATGTTT | 2067 |
| S100A2.1 | NM_005978 | NM_005978.2 | S100A2 | 2369 | TGGCTGTGCTGGTCACTACCT | 604 | TCCCCCTTACTCAGCTTGAACT | 1336 | CACAAGTACTCCTGCCAAGAGGGCGAC | 2068 |
| SAA2.2 | NM_030754 | NM_030754.2 | SAA2 | 6655 | CTACAGCACAGATCAGCACCA | 605 | TGCTGACACTCAGGACCAAG | 1337 | AGCTTCTCACGGGCCTGGTTTCT | 2069 |
| SCN4B.1 | NM_174934 | NM_174934.3 | SCN4B | 7223 | GCCTTCCTGGAGTACCCG | 606 | GTGGCCCTCAATTCCCCAAGT | 1338 | TGCTCCCTATGCCTTTCCAAGCAT | 2070 |
| SCNN1A.2 | NM_001038 | NM_001038.4 | SCNN1A | 3263 | ATCAACACATCCTGTCGAGGCT | 607 | GAAGTTGCCCAGCGTGTC | 1339 | AGAGACTCTGCCATCCCTGGAGGA | 2071 |
| SDHA.1 | NM_004168 | NM_004168.1 | SDHA | 5443 | GCAGAACTGAAGATGGGAAGAT | 608 | CCCTTTCCAAAACTTGAGGC | 1340 | CTGTCCACCAAATGCACGCTGATA | 2072 |
| SDPR.1 | NM_004657 | NM_004657.4 | SDPR | 3877 | ACCAGCACACAAGATGGAGCA | 609 | GGTCATTCTGGATGCCCTT | 1341 | CGGAGCCCTCCAAACTGATCTGTC | 2073 |
| SELE.1 | NM_000450 | NM_000450.1 | SELE | 5383 | ACACTGGTCTGCCCTGCTAC | 610 | AAAGTCCAGCTACCAAGGGAA | 1342 | CCTGTGAAGCTCCCACTGAGTCCA | 2074 |
| SELENBP1.1 | NM_003944 | NM_003944.2 | SELENBP1 | 6200 | GGTACCAGCCTCGACACAA | 611 | CCATCTCGTAAGACATTGGGA | 1343 | TGCCCACTCAGTGCTGATCATGAC | 2075 |
| SELL.1 | NM_000655 | NM_000655.3 | SELL | 5483 | TGCAACTGTGATGTGGGG | 612 | CCTCCAAAGGCTCACACTG | 1344 | CACAAACTGACACTGGGGCCCATA | 2076 |
| SELPLG.1 | NM_003006 | NM_003006.3 | SELPLG | 6316 | TGGCCACTATCTTCTTCGTG | 613 | GTAATTACGCACGGGGTACA | 1345 | CACTGTGGTGCTGGCGGTCC | 2077 |
| SEMA3B.1 | NM_004636 | NM_004636.1 | SEMA3B | 1013 | GCTCCAGGATGTGTTTCTGTTG | 614 | ACGTGAGAAGACGGCATAGA | 1346 | TCGCGGGACCACCGGACC | 2078 |
| SEMA3C.1 | NM_006379 | NM_006379.2 | SEMA3C | 5409 | ATGGCCATTCCTGTTCCAG | 615 | GTCTCACATCTTGTCTTCGGC | 1347 | CCTCCGTTTCCCAGTTGGGTAGAA | 2079 |
| SEMA3F.3 | NM_004186 | NM_004186.1 | SEMA3F | 1008 | CGCGAGCCCCTCATTATACA | 616 | CACTCGCGCGTTGACATCCT | 1348 | CTCCCCACAGCGCATCGAGGAA | 2080 |

TABLE A-continued

| Gene | Accession Num | Sequence_ID | Official Symbol | Gene Version ID | F Primer Seq | SEQ ID NO. | R Primer Seq | SEQ ID NO. | Probe Seq | SEQ ID NO. |
|---|---|---|---|---|---|---|---|---|---|---|
| SEMA5B.1 | NM_001031702 | NM_001031702. | SEMA5B | 5003 | CTCGAGGACAGCTCCAACAT | 617 | TCACATTCCGCACAGGAC | 1349 | AGCCTCTGACCCAGAACATCACC | 2081 |
| SERPINA5.1 | NM_000624 | NM_000624.3 | SERPINA5 | 6201 | CAGCATGGTAGTGGCAAAGA | 618 | CTTTGTGCACTGAGCTGG | 1350 | AGGTCCAGAGTCCTGGCCCTTGAT | 2082 |
| SFN.1 | NM_006142 | NM_006142.3 | SFN | 3580 | GAGAGAGCCAGTCTGATCCA | 619 | AGGCTGCCATGTCCTCATA | 1351 | CTGCTCTGCCAGCTTGGCCTTC | 2083 |
| SGK.1 | NM_005627 | NM_005627.2 | SGK1 | 2960 | TCCGCAAGACACCTCCTG | 620 | TGAAGTCATCCTTGGCCC | 1352 | TGTCCTGTCCTTCTGCAGGAGGC | 2084 |
| SHANK3.1 | XM_037493 | XM_037493.5 | | 3887 | CTGTGCCCTCTACAACCAGG | 621 | GGACATCCCTGTTAGCTCCA | 1353 | AGCTGTGCTCGTGTCCTGCTCTTC | 2085 |
| SHC1.1 | NM_003029 | NM_003029.3 | SHC1 | 2342 | CCAACACCTTCTTGGCTTCT | 622 | CTGTTATCCCAACCCAAACC | 1354 | CCTGTGTTCTTGCTGAGCACCCTC | 2086 |
| SILV.1 | NM_006928 | NM_006928.3 | SILV | 4113 | CCGCATCTTCTGCTCTTGT | 623 | ACTCAGACCTGCTGCCCA | 1355 | TTGGTGAGAATAGCCCCCTCCTCA | 2087 |
| SKIL.1 | NM_005414 | NM_005414.2 | SKIL | 5272 | AGAGGCTGAATATGCAGGACA | 624 | CTATCGGCCTCAGCATGG | 1356 | CCAATCTCTGCCTCAGTTCTGCCA | 2088 |
| SLC13A3.1 | NM_022829 | NM_022829.4 | SLC13A3 | 6202 | CTTGCCCTCCAACAAGGTC | 625 | AGCCACTGAGGAAGAGGA | 1357 | CCCCCAGTACTTCCTCGACACCAA | 2089 |
| SLC16A3.1 | NM_004207 | NM_004207.1 | SLC16A3 | 4569 | ATGCGACCCAGCTCTACAT | 626 | AATCAGGAGGAGGTGAGC | 1358 | CCCCGCCAGGATGAACACGTAC | 2090 |
| SLC22A3.1 | NM_021977 | NM_021977.2 | SLC22A3 | 6506 | ATCGTCAGGACGAGTTTGACCT | 627 | CAGGATGGCTTGGGTGAG | 1359 | CAGCATCCACGCATTGACACAGAC | 2091 |
| SLC22A6.1 | NM_153277 | NM_153277.1 | SLC22A6 | 6463 | TCCGCCACTCTTCCTCT | 628 | GACCAGCCATAGTATGCAAAG | 1360 | CTCTCCATGCTGTGGTTTGCCACT | 2092 |
| SLC2A1.1 | NM_006516 | NM_006516.1 | SLC2A1 | 2966 | GCCTGAGTCTCCTGTGCC | 629 | AGTCTCCACCCTCAGGCAT | 1361 | ACATCCCAGGCTTCACCCTGAATG | 2093 |
| SLC34A1.1 | NM_003052 | NM_003052.3 | SLC34A1 | 6203 | GCTGAGACCCACTGACCTG | 630 | AGCCTCTCTCCGTAGGACAA | 1362 | TCCTGGGCACCCACTATGAGGTCT | 2094 |
| SLC7A5.2 | NM_003486 | NM_003486.4 | SLC7A5 | 3268 | GCGCAGAGGCAGTTAAA | 631 | AGCTGAGCTGTGGGTTGC | 1363 | AGATCACCTCCTCGAACCCACTCC | 2095 |
| SLC9A1.1 | NM_003047 | NM_003047.2 | SLC9A1 | 5385 | CTTCGAGATCTCCCTCTGGA | 632 | AGTGGGGATCACATGGAAAC | 1364 | CCTTCTGGCCTGCCTCATGAAGAT | 2096 |
| SLIT2.2 | NM_004787 | NM_004787.1 | SLIT2 | 3708 | TTTACCGATGCACCTGTCC | 633 | ATGCAGGCATGAATTGGG | 1365 | CACAGTCCTGCCCCTTGAACCAT | 2097 |

TABLE A-continued

| Gene | Accession Num | Sequence_ID | Official Symbol | Gene Version ID | F Primer Seq | SEQ ID NO. | R Primer Seq | SEQ ID NO. | Probe Seq | SEQ ID NO. |
|---|---|---|---|---|---|---|---|---|---|---|
| SNAI1.1 | NM_005985 | NM_005985.2 | SNAI1 | 2205 | CCCAATCGGAAGC CTAACTA | 634 | GTAGGGCTGCTG GAAGGTAA | 1366 | TCTGGATTAGAGTCC TGCAGCTCGC | 2098 |
| SNRK.1 | NM_017719 | NM_017719.4 | SNRK | 6710 | GAGGAAAAGTCAG GGCCG | 635 | GCCGGCTTTCAG AATCATC | 1367 | CCAGCTGCAGTAGTT CGGAGACCA | 2099 |
| SOD1.1 | NM_000454 | NM_000454.3 | SOD1 | 2742 | TGAAGAGAGGCAT GTTGGAG | 636 | AATAGACACATC GGCCACA | 1368 | TTTGTCAGCAGTCAC ATTGCCCAA | 2100 |
| SP3.1 | NM_001017371 | NM_001017371. | SP3 | 5430 | TCAAGAGTCTCAGC AGCCAA | 637 | CCATGGATTGTC TGTGGTGT | 1369 | CAGTCAAGCCCAAAT TGTGCAAGG | 2101 |
| SPARC.1 | NM_003118 | NM_003118.1 | SPARC | 2378 | TCTTCCCTGTACAC TGGCAGTTC | 638 | AGCTCGGTGTGG GAGAGGTA | 1370 | TGGACCAGCACCCC ATTGACGG | 2102 |
| SPARCL1.1 | NM_004684 | NM_004684.2 | SPARCL1 | 3904 | GGCACAGTGCAAG TGATGA | 639 | GATTGAGCTCTC TCCGCCT | 1371 | ACTTCATCCCAAGCC AGGCCTTTC | 2103 |
| SPAST.1 | NM_014946 | NM_014946.3 | SPAST | 4033 | CCTGAGTTGTTCAC AGGGC | 640 | ATTCCCAGGTGG ACCAAAG | 1372 | TAACAGCCCCTCTGGC AGGAGCTCT | 2104 |
| SPHK1.1 | NM_021972 | NM_021972.2 | SPHK1 | 4178 | GGCAGCTTCCTTGA ACCAT | 641 | GCAGTTGGTCAG GAGGTCTT | 1373 | TGTGACCTGCTCAT AGCCAGCAT | 2105 |
| SPRY1.1 | AK026960 | AK026960.1 | | 1051 | CAGACCAGTCCCT GGTCATAGG | 642 | CCTTCAAGTCAT CCACAATCAGTT | 1374 | CTGGGTCCGGATTG CCCTTTCAG | 2106 |
| SQSTM1.1 | NM_003900 | NM_003900.3 | SQSTM1 | 4662 | GGAACCCGTCTACA GGTGAAC | 643 | GCTTGGC GGCTCCAGAGA | 1375 | CAGTCCCTACAGATG CCAGAATCCG | 2107 |
| STAT1.3 | NM_007315 | NM_007315.1 | STAT1 | 530 | GGGCTCAGCTTTCA GAAGTG | 644 | ACATGTTCAGCT GGTCCACA | 1376 | TGGCAGTTTTCTTCT GTCACCAAAA | 2108 |
| STAT3.1 | NM_003150 | NM_003150.1 | STAT3 | 537 | TCCACATGCCACTTT GGTGTT | 645 | CTTGCAGGAAGC GGCTATAC | 1377 | TCCTGGGAGAGATT GACCAGCA | 2109 |
| STAT5A.1 | NM_003152 | NM_003152.1 | STAT5A | 403 | GAGGGCCTCAACA TGAAATTC | 646 | GCCAGGACACG AGGTTCTC | 1378 | CGGTTGCTCTGCACT TCGGCCT | 2110 |
| STAT5B.2 | NM_012448 | NM_012448.1 | STAT5B | 857 | CCAGTGGTGGTGA TCGTTCA | 647 | GCAAAAGCATTG TCCCAGAGA | 1379 | CAGCCAGGACAACA ATGCGACGG | 2111 |
| STC2.1 | NM_003714 | NM_003714.2 | STC2 | 6507 | AAGGAGGCCATCA CCCAC | 648 | AGATGAGCACA GGCTTCC | 1380 | TTCTGCTCACACTGA ACCTGCACG | 2112 |
| STK11.1 | NM_000455 | NM_000455.3 | STK11 | 3383 | GGACTCGGAGACG CTGTG | 649 | GGGATCCTTCGC AACTTCTT | 1381 | TTCTTGAGGATCTTG ACGGCCCTC | 2113 |
| STK15.2 | NM_003600 | NM_003600.1 | AURKA | 341 | CATCTTCCAGGAG GACCACT | 650 | TCCGACCTTCAA TCATTTCA | 1382 | CTCTGTGGCACCCT GGACTACCTG | 2114 |

TABLE A-continued

| Gene | Accession Num | Sequence_ID | Official Symbol | Gene Version ID | F Primer Seq | SEQ ID NO. | R Primer Seq | SEQ ID NO. | Probe Seq | SEQ ID NO. |
|---|---|---|---|---|---|---|---|---|---|---|
| STK4.1 | NM_006282 | NM_006282.2 | STK4 | 5424 | GAGCCATCTTCCTG CAACTT | 651 | CTGAGGTGCAAC CCAGTCA | 1383 | ACCTCCTTCCCTCAG ATGGGAGC | 2115 |
| STMY3.3 | NM_005940 | NM_005940.2 | MMP11 | 741 | CCTGGAGGCTGCA ACATACC | 652 | TACAATGGCTTT GGAGGATAGCA | 1384 | ATCCTCCTGAAGCCC TTTTCGCAGC | 2116 |
| SUCLG1.1 | NM_003849 | NM_003849.2 | SUCLG1 | 6205 | CAAGCCTGTAGT GTCCTTCA | 653 | CGGCCATGACCCA TTCTTC | 1385 | CCCAGGAGAGCAG TTAACCAGC | 2117 |
| SULT1C2.1 | NM_001056 | NM_001056.3 | SULT1C2 | 6206 | GGGACCCAAAGCA TGAAAT | 654 | AGCACTGTTTCA TCCACCTTC | 1386 | TTCCCATGAACTGCA TCACCTTCC | 2118 |
| SURV.2 | NM_001168 | NM_001168.1 | BIRC5 | 81 | TGTTTTGATTCCCG GGCTTA | 655 | CAAAGCTGTCAG CTCTAGCAAAAG | 1387 | TGCCTTCTTCCTCCC TCACTTCTCACCT | 2119 |
| TACSTD2.1 | NM_002353 | NM_002353.2 | TACSTD2 | 6335 | ATCACCAACCGGA GAAAGTC | 656 | AAGCTCGGTTCC TTTCTCAA | 1388 | CCCCCAGTTCCTTGA TCTCCACC | 2120 |
| TAGLN.1 | NM_003186 | NM_003186.3 | TAGLN | 6073 | GATGGAGCAGGTG GCTCAGT | 657 | AGTCTGGAACAT GTCAGTCTTGATG | 1389 | CCCATAGTCCTCAGC CGCCTTCAG | 2121 |
| TAP1.1 | NM_000593 | NM_000593.5 | TAP1 | 3966 | GTATGCTGCTGAAA GTGGGAA | 658 | TCCCACTGCTTA CAGCCC | 1390 | CACCAGCTGCCCAC CAATGTAGAG | 2122 |
| TCF4.1 | NM_003199 | NM_003199.1 | TCF4 | 4097 | CACACCCTGGAAT GGGAG | 659 | ATGTGGCAACTT GGACCCT | 1391 | CGCATCGAATCACAT GGGACAGAT | 2123 |
| TCOF1.2 | NM_001008656 | NM_001008656. | TCOF1 | 6719 | AGCGAGGATGAGG ACGTG | 660 | CACCACATTGGT TCTGATGC | 1392 | TCCCCGCTACACAGT GCTTGACTC | 2124 |
| TEK.1 | NM_000459 | NM_000459.1 | TEK | 2345 | ACTTCGGTGTCTACT TAACAACTTACATC | 661 | CCTGGGCTTGG TGTTGAC | 1393 | AGTTCGGACCACGT ACTGCTCCCTG | 2125 |
| TERT.1 | NM_003219 | NM_003219.1 | | 992 | GACATGGAGAACAA GCTGTTTGC | 662 | GAGGTGTCACCA ACAAGAAATCAT | 1394 | ACCAAACGCAGGAG CAGCCCG | 2126 |
| TFAP2B.1 | NM_003221 | NM_003221.3 | TFAP2B | 6207 | CGTGTGACGTGCG AGAGA | 663 | CCACACGCTTC AGGACC | 1395 | ATGACGCGCCTTG CTCTTACTGT | 2127 |
| TFAP2C.1 | NM_003222 | NM_003222.3 | TFAP2C | 4663 | CATGCCTCACCAGA TGGA | 664 | CTGTCTGATCGT GCAGCAAC | 1396 | CTGGTCGTCGACATT CTGCACCTC | 2128 |
| TFPI.1 | NM_006287 | NM_006287.4 | TFPI | 6270 | CCGAATGGTTTCCA GGTG | 665 | TTGCGGAGTCAG GGAGTTA | 1397 | ATGGAACCCAGTCA ATGCTGTGA | 2129 |
| TGFA.2 | NM_003236 | NM_003236.1 | TGFA | 161 | GGTGTGCCACAGA CCTTCCT | 666 | ACGGAGTTCTTG ACAGAGTTTTGA | 1398 | TTGGCCTGTAATCAC CTGTGCAGCCTT | 2130 |
| TGFb1.1 | NM_000660 | NM_000660.3 | TGFB1 | 4041 | CTGTATTTAAGGAC ACCCGTGC | 667 | TGACACAGAGAT CCGCAGTC | 1399 | TCTCCATCTTTAA TGGGCCCC | 2131 |

TABLE A-continued

| Gene | Accession Num | Sequence_ID | Official Symbol | Gene Version ID | F Primer Seq | SEQ ID NO. | R Primer Seq | SEQ ID NO. | Probe Seq | SEQ ID NO. |
|---|---|---|---|---|---|---|---|---|---|---|
| TGFB2.2 | NM_003238 | NM_003238.1 | TGFB2 | 2017 | ACCAGTCCCCAG AAGACTA | 668 | CCTGGTGCTGTT GTAGATGG | 1400 | TCCTGAGCCCGAGG AAGTCCC | 2132 |
| TGFBI.1 | NM_000358 | NM_000358.1 | TGFBI | 3768 | GCTACGAGTGCTG TCCTGG | 669 | AGTGGTAGGGCT GCTGGAC | 1401 | CCTTCTCCCCAGGG ACCTTTCAT | 2133 |
| TGFBR1.1 | NM_004612 | NM_004612.1 | TGFBR1 | 3385 | GTCATCACCTGGC CTTGG | 670 | GCAGACGAAGCA CACTGGT | 1402 | AGCAATGACAGCTG CCAGTTCCAC | 2134 |
| TGFBR2.3 | NM_003242 | NM_003242.2 | TGFBR2 | 864 | AACACCAATGGGTT CCATCT | 671 | CCTCTTCATCAG GCCAAACT | 1403 | TTTGGGCTCCTGAT TGCTCAAGC | 2135 |
| THBD.1 | NM_000361 | NM_000361.2 | THBD | 4050 | AGATCTGCGACCG ACTGC | 672 | GGAAATGACATC GGCAGC | 1404 | CACCTAATGACAGTG CGTCCTCG | 2136 |
| THBS1.1 | NM_003246 | NM_003246.1 | THBS1 | 2348 | CATCCGCAAAGTGA CTGAAGAG | 673 | GTACTGAACTCC GTTGTGATAGCA TAG | 1405 | CCAATGAGCTGAGG CGGCCTCC | 2137 |
| TIMP1.1 | NM_003254 | NM_003254.2 | TIMP1 | 6075 | TCCCTGCGGTCCC AGATAG | 674 | GTGGGAACAGG GTGGACACT | 1406 | ATCCTGCCCGGAGT GGAAGCTGAAGC | 2138 |
| TIMP2.1 | NM_003255 | NM_003255.2 | TIMP2 | 606 | TCACCCTCTGTGAC TTCATCGT | 675 | TGTGGTTCAGGC TCTTCTCTG | 1407 | CCCTGGGACACCCT GAGCACCA | 2139 |
| TIMP3.3 | NM_000362 | NM_000362.2 | TIMP3 | 593 | CTACCTGCCTTGCT TTGTGA | 676 | ACCGAAATTGGA GAGCATGT | 1408 | CCAAGAACGAGTGT CTCTGGACCG | 2140 |
| TK1.2 | NM_003258 | NM_003258.1 | TK1 | 264 | GCCGGGAAGACCG TAATTGT | 677 | CAGCGGCACCAG GTTCAG | 1409 | CAAATGGCTTCCTCT GGAAGGTCCCA | 2141 |
| TLR3.1 | NM_003265 | NM_003265.2 | TLR3 | 6289 | GGTTGGGCCACCT AGAAGT | 678 | CCATTCCTGGCC TGTGAG | 1410 | CTTGCCCAATTTCAT TAAGCCCA | 2142 |
| TMEM27.1 | NM_020665 | NM_020665.2 | TMEM27 | 3878 | CCCTGAAAGADATGT TGTGGC | 679 | TCTGCACCTGGT TGACAGAG | 1411 | TCTGGTGACTGCCAT TCATGCTGA | 2143 |
| TMEM47.1 | NM_031442 | NM_031442.3 | TMEM47 | 6713 | GGATTCCACTGTTA GAGCCCTT | 680 | GCAAATAACCAA CAGCCAATG | 1412 | CCGCCTGCTTATCCT ACCCAATGA | 2144 |
| TMSB10.1 | NM_021103 | NM_021103.3 | TMSB10 | 6076 | GAAATCGCCAGCTT CGATAA | 681 | GTCGGCAGGGT GTTCTTCT | 1413 | CGTCTCCGTTTTCTT CAGCTTGGC | 2145 |
| TNF.1 | NM_000594 | NM_000594.1 | TNF | 2852 | GGAGAGGGTGAC CGACTCA | 682 | TGCCCAGACTCG GCAAAG | 1414 | CGTGAGATCAATCG GCCCGACTA | 2146 |
| TNFAIP3.1 | NM_006290 | NM_006290.2 | TNFAIP3 | 6290 | ATCGTCTTGGCTGA GAAAGG | 683 | GTGGAATGGCTC TGCTTC | 1415 | CAACCCACGCGACTT GTGTGTCTT | 2147 |

TABLE A-continued

| Gene | Accession Num | Sequence_ID | Official Symbol | Gene Version ID | F Primer Seq | SEQ ID NO. | R Primer Seq | SEQ ID NO. | Probe Seq | SEQ ID NO. |
|---|---|---|---|---|---|---|---|---|---|---|
| TNFAIP6.1 | NM_007115 | NM_007115.2 | TNFAIP6 | 6291 | AGGAGTGAAGATGGGATGC | 684 | CTGTAAAGACGCCACCACAC | 1416 | ATTGCTACAACCCACACGCAAAGG | 2148 |
| TNFRSF10C.3 | NM_003841 | NM_003841.2 | TNFRSF10$$ | 6652 | GGAGTTGACCAGAGATGCAA | 685 | CTCTGTCCCCAGAGTTCCC | 1417 | AACGTAGGAAGCGCTCCTTCACC | 2149 |
| TNFRSF10D.1 | NM_003840 | NM_003840.3 | TNFRSF10$$ | 4406 | CCTCTCGCTTCTGGTGGTC | 686 | GCTCAGGAATCTCTGCCCTA | 1418 | AGGCATCCAGGGACTCAGTTCAC | 2150 |
| TNFRSF11B.1 | NM_002546 | NM_002546.2 | TNFRSF11$$ | 4675 | TGGCGACCAAGACACCTT | 687 | GGGAAAGTGGTACGTCTTTGAG | 1419 | AGGGCCTAATGCACGCACTAAAGC | 2151 |
| TNFRSF1A.1 | NM_001065 | NM_001065.2 | TNFRSF1A | 4943 | ACTGCCCTGAGCCCAAAT | 688 | GTCAGGCACGGTGGAGAG | 1420 | TGCCAGACAGCTATGGCCTCTCAC | 2152 |
| TNFSF12.1 | NM_003809 | NM_003809.2 | TNFSF12 | 2987 | TAGGCCAGGAGGTTCCCAA | 689 | CACAGGGAATTCTCAAGGGA | 1421 | TTGTCTTGTTTCTCGCCCCTCACA | 2153 |
| TNFSF13B.1 | NM_006573 | NM_006573.3 | TNFSF13B | 4944 | CCTACGCCATGGGACATC | 690 | TCGAAACAAAGTCACCAGACTC | 1422 | TCCCCAAAGACATGGACCTTCTTCC | 2154 |
| TNFSF7.1 | NM_001252 | NM_001252.2 | CD70 | 4101 | CCAACTCACTGGGACACTT | 691 | ACCCACTGCACTCCAAAGAA | 1423 | TGCCTTCCCGAAACACTGATGAGA | 2155 |
| TNIP2.1 | NM_024309 | NM_024309.2 | TNIP2 | 3872 | CATGTCAGAAAGGGCCGA | 692 | GCGACCTTTTCCTCCAGTT | 1424 | AATCCTACTTTGAGCCCGTTCCCG | 2156 |
| TOP2A.4 | NM_001067 | NM_001067.1 | TOP2A | 74 | AATCCAAGGGGGAGAGTGAT | 693 | GTACAGATTTTGCCCGAGGA | 1425 | CATATGGACTTTGACTCAGTGTGGC | 2157 |
| TOP2B.2 | NM_001068 | NM_001068.1 | TOP2B | 75 | TGTGGACATCTTTCCCTCAGA | 694 | CTAGCCCGACCGGTTCGT | 1426 | TTCCCTACTGAGCCACCTTCTCTG | 2158 |
| TP.3 | NM_001953 | NM_001953.2 | TYMP | 91 | CTATATGCAGCCAGAGATGTGACA | 695 | CCACGAGTTTCTTACTGAGAATGG | 1427 | ACAGCCTGCCACTCATCACAGCC | 2159 |
| TRAIL.1 | NM_003810 | NM_003810.1 | TNFSF10 | 898 | CTTCCACAGTGCTGTCCTGCAGTCT | 696 | CATCTGCTTCAGCTCGTTGGT | 1428 | AAGTACACGTAAGTTACAGCCACACA | 2160 |
| TS.1 | NM_001071 | NM_001071.1 | TYMS | 76 | GCCTCGGTGTGCCTTTCA | 697 | CGTGATGTGCGCAATCATG | 1429 | CATGCCAGCTACGCCCTGCTC | 2161 |
| TSC1.1 | NM_000368 | NM_000368.3 | TSC1 | 6292 | TCACCAAATCCAGCCCG | 698 | GTGTCAGCATAAGGGCTGGT | 1430 | TTTCCTCATCGTTCAGCCGATGTC | 2162 |
| TSC2.1 | NM_000548 | NM_000548 | TSC2 | 5132 | CACAGTGGCCTCTTTCTCCT | 699 | CAGGAAACGCTCCTGTGC | 1431 | TACCAGTCCAGCTGCCAAGGACAG | 2163 |
| TSPAN7.2 | NM_004615 | NM_004615.3 | TSPAN7 | 6721 | ATCACTGGGGTGATCCTGC | 700 | GGGAGATATAGGTGCCAGAG | 1432 | AAGTTGCCCCAGACTCCAACAGC | 2164 |

TABLE A-continued

| Gene | Accession Num | Sequence_ID | Official Symbol | Gene Version ID | F Primer Seq | SEQ ID NO. | R Primer Seq | SEQ ID NO. | Probe Seq | SEQ ID NO. |
|---|---|---|---|---|---|---|---|---|---|---|
| TSPAN8.1 | NM_004616 | NM_004616.2 | TSPAN8 | 6317 | CAGAAATCTCTGCAGGCAAGT | 701 | AATCCAGATGCCGTGAATTT | 1433 | TGTCCAGAGCATATTGCAGGACA | 2165 |
| TUBB.1 | NM_001069 | NM_001069.1 | TUBB2A | 2094 | CGAGGACGAGGCTTAAAAAC | 702 | ACCATGCTTGAGGACAACAG | 1434 | TCTCAGATCAATCGTGCATCCTTAGTGAA | 2166 |
| TUSC2.1 | NM_007275 | NM_007275.1 | TUSC2 | 6208 | CACCAAGAACGGGCAGAA | 703 | CGATGCCCTGAGGAATCA | 1435 | TCTTATGCACTCGCCTCAGCTTGG | 2167 |
| tusc4.2 | NM_006545 | NM_006545.4 | TUSC4 | 3764 | GGAGGAGCTAAATGCCTCAG | 704 | CCTTCAAGTGGATGGTGTTG | 1436 | ACTCATCAATGGGCAGAGTGCACC | 2168 |
| TXLNA.1 | NM_175852 | NM_175852.3 | TXLNA | 6209 | GCCAGAACGGCTCAGTCT | 705 | ATGTCTTCCAGTTGGCGG | 1437 | TCCTCAGAGACATCACGAAGGGCC | 2169 |
| UBB.1 | NM_018955 | NM_018955.1 | UBB | 3303 | GAGTGCACCCTGACCTG | 706 | GCGAATGCCATGACTGAA | 1438 | AATTAACAGCCACCCCTCAGGCG | 2170 |
| UBA3 | NM_003968 | NM_003968.3 | UBA3 | 2575 | GAATGCACGCTGGAACTTTA | 707 | CTGGTAGCCTGGGCATAGA | 1439 | AATTTTCCCATGTGCACCATTGCA | 2171 |
| UBE1C.1 | NM_007019 | NM_007019.2 | UBE2C | 2550 | TGTCTGGCGATAAAGGGATT | 708 | ATGGTCCTACCCATTTGAA | 1440 | TCTGCCTTCCCTGAATCAGACAACC | 2172 |
| UBE2C.1 | NM_014176 | NM_014176.1 | UBE2T | 3882 | TGTTCTCAAATTGCCACCAA | 709 | AGAGGTCAACACAGTTGCGA | 1441 | AGGTGCTTGGAGACCATCCCTCAA | 2173 |
| UBE2T.1 | NM_003358 | NM_003358.1 | UGCG | 6210 | GGCAACTGACAAACAGCCTT | 710 | AGGATCTACCCCTTTCAGTGG | 1442 | CAAGCTCCCAGGTGTCTCTCTTCTGA | 2174 |
| UGCG.1 | NM_003361 | NM_003361.2 | UMOD | 6211 | GCGTGGACCTGATGAGT | 711 | TTACGCAGCTGCTGTTGG | 1443 | CCATTCCTGGAGCTCACAACTGCT | 2175 |
| UMOD.1 | NM_002658 | NM_002658.1 | PLAU | 89 | GTGGATGTGCCCTGAAGGA | 712 | CTGCGGATCCAGGGTAAGAA | 1444 | AAGCCAGGCGTCTACACGAGAGTCTCAC | 2176 |
| upa.3 | NM_014709 | NM_014709.2 | USP34 | 4040 | AAGCTGTGATGGCCAAGC | 713 | GGAATGGCCACAACTGAGA | 1445 | TCCCAGGACCCTGAGGTTGCTTTA | 2177 |
| USP34.1 | NM_001078 | NM_001078.2 | VCAM1 | 1220 | TGGCTTCAGGAGCTGAATACC | 714 | TGCTGTCGTGATGAGAAATAGTG | 1446 | CAGGCACACACAGGTGGGACACAAAT | 2178 |
| VCAM1.1 | NM_004385 | NM_004385.2 | VCAN | 5979 | CCTGCTACACAGCCAACAAG | 715 | AGAAAGCGCCTGAGTCC | 1447 | CCCACTGTGGAAGACAAAGAGGCC | 2179 |
| VCAN.1 | NM_000376 | NM_000376.1 | VDR | 971 | GCCCTGGATTTCAGAAAGAG | 716 | AGTTACAAGCCAGGGAAGGA | 1448 | CAAGTCTGGATCTGGGACCCTTTCC | 2180 |
| VDR.2 | NM_003376 | NM_003376.3 | VEGFA | 7 | CTGCTGTCTTTGGGTGCATTG | 717 | GCAGCCTGGGACCACTTG | 1449 | TTGCTTGCTGCTCTACCTCCACCA | 2181 |

TABLE A-continued

| Gene | Accession Num | Sequence_ID | Official Symbol | Gene Version ID | F Primer Seq | SEQ ID NO. | R Primer Seq | SEQ ID NO. | Probe Seq | SEQ ID NO. |
|---|---|---|---|---|---|---|---|---|---|---|
| VEGFB.1 | NM_003377 | NM_003377.2 | VEGFB | 964 | TGACGATGGCCTGGAGTGT | 718 | GGTACCGGATCATGAGGATCTG | 1450 | CTGGGCAGCACCAAGTCCGGA | 2182 |
| VHL.1 | NM_000551 | NM_000551.2 | VHL | 4102 | CGGTTGTGACTTGTCTGC | 719 | AAGACTTGTCCCTGCCTCAC | 1451 | ATGCCTCAGTCTTCCCAAAGCAGG | 2183 |
| VIM.3 | NM_003380 | NM_003380.1 | VIM | 339 | TGCCCTTAAAGGAACCAATGA | 720 | GCTTCAACGGCAAAGTTCTT | 1452 | ATTTCACGCATCTGGCGTTCCA | 2184 |
| VTCN1.1 | NM_024626 | NM_024626.2 | VTCN1 | 4754 | ACAGTGGTCTGGGCATCC | 721 | GCTCAAAGCTGGTATTGGAGAC | 1453 | CGAGAAGTTGGCTCCCTGGTCAAC | 2185 |
| VTN.1 | NM_000638 | NM_000638.2 | VTN | 4502 | AGTCAATCTTCCCACACGG | 722 | GTACTGAGCGATGGAGCGT | 1454 | TGGACACTGTGGACCCTCCCTACC | 2186 |
| VWF.1 | NM_000552 | NM_000552.3 | VWF | 6212 | TGAAGCACAGTGCCCTCTC | 723 | CCAGTCTCCCATTCACCGT | 1455 | CTCCATGTCACTGTGCAGCTCGAC | 2187 |
| WIF.1 | NM_007191 | NM_007191.3 | WIF1 | 6077 | AACAAGCTGAGTGCCCAGG | 724 | CACTCGCAGATGCGTCTTT | 1456 | TACAAAAGCCTCCATTTCCGCACC | 2188 |
| WISP1.1 | NM_003882 | NM_003882.2 | WISP1 | 603 | AGAGGCATCCATGAACTTCACA | 725 | CAAAACTCCACAGTACTTGGGTTGA | 1457 | CGGGCTGCATCAGCACACGC | 2189 |
| WT1.1 | NM_000378 | NM_000378.3 | WT1 | 6458 | TGTACGGTCGGCATCTGAG | 726 | TTATTGCAGCCTGGGTAAGC | 1458 | CAGTGAGAAACGCCCCTTCATGTG | 2190 |
| WWOX.5 | NM_016373 | NM_016373.1 | WWOX | 974 | ATCGCAGCTGTGGGTGTAC | 727 | AGTCCCCTGTTGCATGGACTT | 1459 | CTGCTGTTTACCTTGGCGAGGCCTTTC | 2191 |
| XDH.1 | NM_000379 | NM_000379.3 | XDH | 5089 | TGGTGGCAGACATCCCTT | 728 | GCCACACTGTCCCAGTCTT | 1460 | TGAAGCCAACCTTGTATCTGGCCA | 2192 |
| XIAP.1 | NM_001167 | NM_001167.1 | XIAP | 80 | GCAGTTGGAAGACACAGAAAGT | 729 | TGCGTGGCACTATTTTCAAGA | 1461 | TCCCCAAATTGCAGATTTATCAACGGC | 2193 |
| XPNPEP2.2 | NM_003399 | NM_003399.5 | XPNPEP2 | 6503 | CACCCTGCACTGAACATACC | 730 | AAGGAGGATGAATGCAAAGG | 1462 | CCTGCTGGCCCATTGCCTAGAA | 2194 |
| YB-1.2 | NM_004559 | NM_004559.1 | YBX1 | 395 | AGACTGTGGAGTTTGATGTTGTTGA | 731 | GGAACACCACCAGGACCTGTAA | 1463 | TTGCTGCCTCCGCACCCCTTTCT | 2195 |
| ZHX2.1 | NM_014943 | NM_014943.3 | ZHX2 | 6215 | GAGTACGACCAGTTAGCGGC | 732 | TCTCCTTGAACCAACGCAC | 1464 | ATCTCAGTTCGGACCAGGCCAGTC | 2196 |

TABLE B

| Gene | Target Sequence Length | Amplicon Sequence | SEQ ID NO. |
|---|---|---|---|
| A-Catenin.2 | 78 | CGTTCCGATCCTCTATACTGCATCCCAGGCATGCCTACAGCACCCTGATGTCGCAGCCTAT AAGGCCAACAGGGACCT | 2197 |
| A2M.1 | 66 | CTCTCCCGCCTTCCTAGCTGTCCCAGTGGAGAAGGAACAAGCGCCTCACTGCATCTGTGCA AACGG | 2198 |
| AAMP.1 | 66 | GTGTGGCAGGTGGACACTAAGGAGGAGGTCTGGTCCTTTGAAGCGGGAGACCTGGAGTGGA TGGAG | 2199 |
| ABCB1.5 | 77 | AAACACCACTGGAGCATTGACTACCAGGCTCGCCAATGATGCTGCTCAAGTTAAAGGGGCT ATAGGTTCCAGGCTTG | 2200 |
| ACADSB.1 | 68 | TGGCGGAGAACTAGCCATCAGCCTCCTGAAGCCTGCCATCATTGTTAATTTGAGGACTGGG CTGTCTT | 2201 |
| ACE.1 | 67 | CCGCTGTACGAGGATTTCACTGCCCTCAGCAATGAAGCCTACAAGCAGGACGGCTTCACAG ACACGG | 2202 |
| ACE2.1 | 66 | TACAATGAGAGGCTCTGGGCTTGGGAAAGCTGGAGATCTGAGGTCGGCAAGCAGCTGAGGC CATTA | 2203 |
| ADAM17.1 | 73 | GAAGTGCCAGGAGGCGATTAATGCTACTTGCAAAGGCGTGTCCTACTGCACAGGTAATAGC AGTGAGTGCCCG | 2204 |
| ADAM8.1 | 67 | GTCACTGTGTCCAGCCCACCCTTCCCAGTTCCTGTCTACACCCGGCAGGCACCAAAGCAGG TCATCA | 2205 |
| ADAMTS1.1 | 73 | GGACAGGTGCAAGCTCATCTGCCAAGCCAAAGGCATTGGCTACTTCTTCGTTTTGCAGCCC AAGGTTGTAGAT | 2206 |
| ADAMTS2.1 | 66 | GAGAATGTCTGCCGCTGGGCCTACCTCCAGCAGAAGCCAGACACGGGCCACGATGAATACC ACGAT | 2207 |
| ADAMTS4.1 | 71 | TTTGACAAGTGCATGGTGTGCGGAGGGGACGGTTCTGGTTGCAGCAAGCAGTCAGGCTCCT TCAGGAAATT | 2208 |
| ADAMTS5.1 | 79 | CACTGTGGCTCACGAAATCGGACATTTACTTGGCCTCTCCCATGACGATTCCAAATTCTGT GAAGAGACCTTTGGTTCC | 2209 |
| ADAMTS8.1 | 72 | GCGAGTTCAAAGTGTTCGAGGCCAAGGTGATTGATGGCACCCTGTGTGGGCCAGAAACACT GGCCATCTGTG | 2210 |
| ADAMTS9.1 | 66 | GCACAGGTTACACAACCCAACAGAATGTCCCTATAACGGGAGCCGGCGCGATGACTGCCAA TGTCG | 2211 |
| ADD1.1 | 74 | GTCTACCCAGCAGCTCCGCAAGGAGGGATGGCTGCCTTAAACATGAGTCTTGGTATGGTGA CTCCTGTGAACGA | 2212 |
| ADFP.1 | 67 | AAGACCATCACCTCCGTGGCCATGACCAGTGCTCTGCCCATCATCCAGAAGCTAGAGCCGC AAATTG | 2213 |
| ADH1B.1 | 84 | AAGCCAACAAACCTTCCTTCTTAACCATTCTACTGTGTCACCTTTGCCATTGAGGAAAAT ATTCCTGTGACTTCTTGCATTTT | 2214 |
| ADH6.1 | 68 | TGTTGGGGAGTAAACACTTGGACCTCTTGTATCCCACCATCTTGGGCCATGAAGGGGCTGG AATCGTT | 2215 |
| ADM.1 | 75 | TAAGCCACAAGCACACGGGGCTCCAGCCCCCCCGAGTGGAAGTGCTCCCCACTTTCTTTAG GATTTAGGCGCCCA | 2216 |
| AGR2.1 | 70 | AGCCAACATGTGACTAATTGGAAGAAGAGCAAAGGGTGGTGACGTGTTGATGAGGCAGATG GAGATCAGA | 2217 |
| AGT.1 | 73 | GATCCAGCCTCACTATGCCTCTGACCTGGACAAGGTGGAGGGTCTCACTTTCCAGCAAAAC TCCCTCAACTGG | 2218 |
| AGTR1.1 | 67 | AGCATTGATCGATACCTGGCTATTGTTCACCCAATGAAGTCCCGCCTTCGACGCACAATGC TTGTAG | 2219 |
| AHR.1 | 69 | GCGGCATAGAGACCGACTTAATACAGAGTTGGACCGTTTGGCTAGCCTGCTGCCTTTCCCA CAAGATGT | 2220 |
| AIF1.1 | 71 | GACGTTCAGCTACCCTGACTTTCTCAGGATGATGCTGGGCAAGAGATCTGCCATCCTAAAA ATGATCCTGA | 2221 |

TABLE B-continued

| Gene | Target Sequence Length | Amplicon Sequence | SEQ ID NO. |
|---|---|---|---|
| AKT1.3 | 71 | CGCTTCTATGGCGCTGAGATTGTGTCAGCCCTGGACTACCTGCACTCGGAGAAGAACGTGG TGTACCGGGA | 2222 |
| AKT2.3 | 71 | TCCTGCCACCCTTCAAACCTCAGGTCACGTCCGAGGTCGACACAAGGTACTTCGATGATGA ATTTACCGCC | 2223 |
| AKT3.2 | 75 | TTGTCTCTGCCTTGGACTATCTACATTCCGGAAAGATTGTGTACCGTGATCTCAAGTTGGA GAATCTAATGCTGG | 2224 |
| ALDH4.2 | 68 | GGACAGGGTAAGACCGTGATCCAAGCGGAGATTGACGCTGCAGCGGAACTCATCGACTTCT TCCGGTT | 2225 |
| ALDH6A1.1 | 66 | GGCTCTTTCAACAGCAGTCCTTGTGGGAGAAGCCAAGAAGTGGCTGCCAGAGCTGGTGGAG CATGC | 2226 |
| ALDOA.1 | 69 | GCCTGTACGTGCCAGCTCCCCGACTGCCAGAGCCTCAACTGTCTCTGCTTCGAGATCAAGC TCCGATGA | 2227 |
| ALDOB.1 | 80 | CCCTCTACCAGAAGGACAGCCAGGGAAAGCTGTTCAGAAACATCCTCAAGGAAAAGGGATC GTGGTGGGAATCAAGTTA | 2228 |
| ALOX12.1 | 67 | AGTTCCTCAATGGTGCCAACCCCATGCTGTTGAGACGCTCGACCTCTCTGCCCTCCAGGCT AGTGCT | 2229 |
| ALOX5.1 | 66 | GAGCTGCAGGACTTCGTGAACGATGTCTACGTGTACGGCATGCGGGGCCGCAAGTCCTCAG GCTTC | 2230 |
| AMACR1.1 | 71 | GGACAGTCAGTTTTAGGGTTGCCTGTATCCAGTAACTCGGGGCCTGTTTCCCCGTGGGTCT CTGGGCTGTC | 2231 |
| ANGPT1.1 | 71 | TCTACTTGGGGTGACAGTGCTCACGTGGCTCGACTATAGAAAACTCCACTGACTGTCGGGC TTTAAAAAGG | 2232 |
| ANGPT2.1 | 69 | CCGTGAAAGCTGCTCTGTAAAAGCTGACACAGCCCTCCCAAGTGAGCAGGACTGTTCTTCC CACTGCAA | 2233 |
| ANGPTL2.1 | 66 | GCCATCTGCGTCAACTCCAAGGAGCCTGAGGTGCTTCTGGAGAACCGAGTGCATAAGCAGG AGCTA | 2234 |
| ANGPTL3.3 | 78 | GTTGCGATTACTGGCAATGTCCCCAATGCAATCCCGGAAAACAAAGATTTGGTGTTTTCTA CTTGGGATCACAAAGCA | 2235 |
| ANGPTL4.1 | 66 | ATGACCTCAGATGGAGGCTGGACAGTAATTCAGAGGCGCCACGATGGCTCAGTGGACTTCA ACCGG | 2236 |
| ANGPTL7.1 | 67 | CTGCACAGACTCCAACCTCAATGGAGTGTACTACCGCCTGGGTGAGCACAATAAGCACCTG GATGGC | 2237 |
| ANTXR1.1 | 67 | CTCCAGGTGTACCTCCAACCCTAGCCTTCTCCCACAGCTGCCTACAACAGAGTCTCCCAGC CTTCTC | 2238 |
| ANXA1.2 | 67 | GCCCCTATCCTACCTTCAATCCATCCTCGGATGTCGCTGCCTTGCATAAGGCCATAATGGT TAAAGG | 2239 |
| ANXA2.2 | 71 | CAAGACACTAAGGGCGACTACCAGAAAGCGCTGCTGTACCTGTGTGGTGGAGATGACTGAA GCCCGACACG | 2240 |
| ANXA4.1 | 67 | TGGGAGGGATGAAGGAAATTATCTGGACGATGCTCTCGTGAGACAGGATGCCCAGGACCTG TATGAG | 2241 |
| ANXA5.1 | 67 | GCTCAAGCCTGGAAGATGACGTGGTGGGGACACTTCAGGGTACTACCAGCGGATGTTGGT GGTTCT | 2242 |
| AP-1 (JUN official).2 | 81 | GACTGCAAAGATGGAAACGACCTTCTATGACGATGCCCTCAACGCCTCGTTCCTCCCGTCC GAGAGCGGACCTTATGGCTA | 2243 |
| AP1M2.1 | 67 | ACAACGACCGCACCATCTCCTTCATCCCGCCTGATGGTGACTTTGAGCTCATGTCATACCG CCTCAG | 2244 |
| APAF1.2 | 66 | CACAAGGAAGAAGCTGGTGAATGCAATTCAGCAGAAGCTCTCCAAATTGAAAGGTGAACCA GGATG | 2245 |
| APC.4 | 69 | GGACAGCAGGAATGTGTTTCTCCATACAGGTCACGGGGAGCCAATGGTTCAGAAACAAATC GAGTGGGT | 2246 |

TABLE B-continued

| Gene | Target Sequence Length | Amplicon Sequence | SEQ ID NO. |
|---|---|---|---|
| APOC1.3 | 70 | CCAGCCTGATAAAGGTCCTGCGGGCAGGACAGGACCTCCCAACCAAGCCCTCCAGCAAGGATTCAGAGTG | 2247 |
| APOE.1 | 75 | GCCTCAAGAGCTGGTTCGAGCCCCTGGTGGAAGACATGCAGCGCCAGTGGGCCGGGCTGGTGGAGAAGGTGCAGG | 2248 |
| APOL1.1 | 73 | CGGACCAAGAACTGTGACCACAGGGCAGGGCAGCCACCAGGAGAGATATGCCTGGCAGGGGCCAGGACAAAAT | 2249 |
| APOLD1.1 | 66 | GAGCAGCTGGAGTCTCGGGTTCAGCTCTGCACCAAGTCCAGTCGTGGCCACGACCTCAAGATCTCT | 2250 |
| AQP1.1 | 66 | GCTTGCTGTATGACCCCTGGCCACAGCCTTCCCTCTGCATTGACCTGGAGGGGAGAGGTCAGCCTT | 2251 |
| AREG.2 | 82 | TGTGAGTGAAATGCCTTCTAGTAGTGAACCGTCCTCGGGAGCCGACTATGACTACTCAGAAGAGTATGATAACGAACCACAA | 2252 |
| ARF1.1 | 64 | CAGTAGAGATCCCCGCAACTCGCTTGTCCTTGGGTCACCCTGCATTCCATAGCCATGTGCTTGT | 2253 |
| ARG99.1 | 67 | GCATGGGCTACTGCATCCTTTTTGTGCACGGACTGAGCAAGCTCTGCACTTGGCTGAATCGATGTGG | 2254 |
| ARGHEF18.1 | 71 | ACTCTGCTTCCCAAGGGCAACCGTTGCTGTTCACACGCTCAGCCTGTCTGGGGGAGCGGGCCTCTAGCTTC | 2255 |
| ARHA.1 | 73 | GGTCCTCCGTCGGTTCTCTCATTAGTCCACGGTCTGGTCTTCAGCTACCCGCCTTCGTCTCCGAGTTTGCGAC | 2256 |
| ARHGDIB.1 | 66 | TGGTCCCTAGAACAAGAGGCTTAAAACCGGGCTTTCACCCAACCTGCTCCCTCTGATCCTCCATCA | 2257 |
| ARRB1.1 | 69 | TGCAGGAACGCCTCATCAAGAAGCTGGGCGAGCACGCTTACCCTTTCACCTTTGAGATCCCTCCAAACC | 2258 |
| ASS1.1 | 85 | CCCCCAGATAAAGGTCATTGCTCCCTGGAGGATGCCTGAATTCTACAACCGGTTCAAGGGCCGCAATGACCTGATGGAGTACGCA | 2259 |
| ATP1A1.1 | 67 | AGAACGCCTATTTGGAGCTGGGGGGCCTCGGAGAACGAGTCCTAGGTTTCTGCCACCTCTTTCTGCC | 2260 |
| ATP5E.1 | 66 | CCGCTTTCGCTACAGCATGGTGGCCTACTGGAGACAGGCTGGACTCAGCTACATCCGATACTCCCA | 2261 |
| ATP6V1B1.1 | 67 | AACCATGGGGAACGTCTGCCTCTTCCTGAACTTGGCCAATGACCCCACGATCGAGCGGATCATCACC | 2262 |
| AXL.1 | 66 | TTGCAGCCCTGTCTTCCTACCTATCCCACCTCCATCCCAGACAGGTCCCTCCCCTTCTCTGTGCAG | 2263 |
| AZU1.1 | 74 | CCGAGGCCCTGACTTCTTCACCCGAGTGGCGCTCTTCCGAGACTGGATCGATGGTGTTCTCAACAACCCGGGAC | 2264 |
| B-Catenin.3 | 80 | GGCTCTTGTGCGTACTGTCCTTCGGGCTGGTGACAGGGAAGACATCACTGAGCCTGCCATCTGTGCTCTTCGTCATCTGA | 2265 |
| B2M.4 | 67 | GGGATCGAGACATGTAAGCAGCATCATGGAGGTTTGAAGATGCCGCATTTGGATTGGATGAATTCCA | 2266 |
| BAD.1 | 73 | GGGTCAGGGGCCTCGAGATCGGGCTTGGGCCCAGAGCATGTTCCAGATCCCAGAGTTTGAGCCGAGTGAGCAG | 2267 |
| BAG1.2 | 81 | CGTTGTCAGCACTTGGAATACAAGATGGTTGCCGGGTCATGTTAATTGGGAAAAAGAACAGTCCACAGGAAGAGGTTGAAC | 2268 |
| BAG2.1 | 69 | CTAGGGGCAAAAGCATGACTGCTTTTTCCTGTCTGGCATGGAATCACGCAGTCACCTTGGGCATTTAG | 2269 |
| Bak.2 | 66 | CCATTCCCACCATTCTACCTGAGGCCAGGACGTCTGGGGTGTGGGATTGGTGGGTCTATGTTCCC | 2270 |
| Bax.1 | 70 | CCGCCGTGGACACAGACTCCCCCCGAGAGGTCTTTTTCCGAGTGGCAGCTGACATGTTTTCTGACGGCAA | 2271 |

TABLE B-continued

| Gene | Target Sequence Length | Amplicon Sequence | SEQ ID NO. |
|---|---|---|---|
| BBC3.2 | 83 | CCTGGAGGGTCCTGTACAATCTCATCATGGGACTCCTGCCCTTACCCAGGGGCCACAGAGCCCCCGAGATGGAGCCCAATTAG | 2272 |
| Bcl2.2 | 73 | CAGATGGACCTAGTACCCACTGAGATTTCCACGCCGAAGGACAGCGATGGGAAAAATGCCCTTAAATCATAGG | 2273 |
| BCL2A1.1 | 79 | CCAGCCTCCATGTATCATCATGTGTCATAACTCAGTCAAGCTCAGTGAGCATTCTCAGCACATTGCCTCAACAGCTTCA | 2274 |
| BCL2L12.1 | 73 | AACCCACCCCTGTCTTGGAGCTCCGGGTAGCTCTCAAACTCGAGGCTGCGCACCCCCTTTCCCGTCAGCTGAG | 2275 |
| Bclx.2 | 70 | CTTTTGTGGAACTCTATGGGAACAATGCAGCAGCCGAGAGCCGAAAGGGCCAGGAACGCTTCAACCGCTG | 2276 |
| BCRP.1 | 74 | TGTACTGGCGAAGAATATTTGGTAAAGCAGGGCATCGATCTCTCACCCTGGGGCTTGTGGAAGAATCACGTGGC | 2277 |
| BFGF.3 | 71 | CCAGGAAGAATGCTTAAGATGTGAGTGGATGGATCTCAATGACCTGGCGAAGACTGAAAATACAACTCCCATCACCA | 2278 |
| BGN.1 | 66 | GAGCTCCGCAAGGATGACTTCAAGGGTCTCCAGCACCTCTACGCCCTCGTCCTGGTGAACAACAAG | 2279 |
| BHLHB3.1 | 68 | AGGAAGATCCCTCGCAGCCAGGAAAGGAAGCTCCCTGAATCCTTGCGTCCCGAAGGACGGAGGTTCAA | 2280 |
| BIK.1 | 70 | ATTCCTATGGCTCTGCAATTGTCACCGGTTAACTGTGGCCTGTGCCCAGGAAGAGCCATTCACTCCTGCC | 2281 |
| BIN1.3 | 76 | CCTGCAAAAGGGAACAAGAGCCCTTCGCCTCCAGATGGCTCCCCTGCCGCCACCCCGAGATCAGAGTCAACCACG | 2282 |
| BLR1.1 | 67 | GACCAAGCAGGAAGCTCAGACTGGTTGAGTTCAGGTAGCTGCCCCTGGCTCTGACCGAAACAGCGCT | 2283 |
| BNIP3.1 | 68 | CTGGACGGAGTAGCTCCAAGAGCTCTCACTGTGACAGCCCACCTCGCTCGCAGACACCACAGATACC | 2284 |
| BRCA1.1 | 65 | TCAGGGGGCTAGAAATCTGTTGCTATGGGCCCTTCACCAACATGCCCACAGATCAACTGGAATGG | 2285 |
| BTRC.1 | 63 | GTTGGGACACAGTTGGTCTGCAGTCGGCCCAGGACGGTCTACTCAGCACAACTGACTGCTTCA | 2286 |
| BUB1.1 | 68 | CCGAGGTTAATCCAGCACGTATGGGGCCAAGTGTAGGCTCCCAGCAGGAACTGAGAGCGCCATGTCTT | 2287 |
| BUB3.1 | 73 | CTGAAGCAGATGGTTCATCATTTCCTGGGCTGTTAAACAAAGCGAGGTTAAGGTTAGACTCTTGGGAATCAGC | 2288 |
| c-kit.2 | 75 | GAGGCAACTGCTTATGGCTTAATTAAGTCAGATGCGGCCATGACTGTCGCTGTAAAGATGCTCAAGCCGAGTGCC | 2289 |
| C13orf15.1 | 84 | TAGAATCTGCTGCCAGAGGGGACAAAGACGTGCACTCAACCTTCTACCAGGCCACTCTCAGGCTCACCTTAAAATCAGCCCTTG | 2290 |
| C1QA.1 | 66 | CGGTCATCACCAACCAGGAAGAACCGTACCAGAACCACTCCGGCCGATTCGTCTGCACTGTACCCG | 2291 |
| C1QB.1 | 70 | CCAGTGGCCTCACAGGACACCAGCTTCCCAGGAGGCGTCTGACACAGTATGATGATGAAGATCCCATGGG | 2292 |
| C20orf1.1 | 65 | TCAGCTGTGAGCTGCGGATACCGCCCGGCAATGGGACCTGCTCTTAACCTCAAACCTAGGACCGT | 2293 |
| C3.1 | 67 | CGTGAAGGAGTGCAGAAAGAGGACATCCCACCTGCAGACCTCAGTGACCAAGTCCCGGACACCGAGT | 2294 |
| C3AR1.1 | 66 | AAGCCGCATCCCAGACTTGCTGAATCGGAATCTCTGGGGGTTGGGACCCAGCAAGGGCACTTAACA | 2295 |
| C7.1 | 69 | ATGTCTGAGTGTGAGGCGGGCGCTCTGAGATGCAGAGGGCAGAGCATCTCTGTCACCAGCA | 2296 |
| CA12.1 | 66 | CTCTCTGAAGGTGTCCTGGCCAGCCCTGGAGAAGCACTGGTGTCTGCAGCACCCCTCAGTTCCTGT | 2297 |

TABLE B-continued

| Gene | Target Sequence Length | Amplicon Sequence | SEQ ID NO. |
|---|---|---|---|
| CA2.1 | 69 | CAACGTGGAGTTTGATGACTCTCAGGACAAAGCAGTGCTCAAGGGAGGACCCCTGGATGGCACTTACAG | 2298 |
| CA9.3 | 72 | ATCCTAGCCCTGGTTTTTGGCCTCCTTTTTGCTGTCACCAGCGTCGCGTTCCTTGTGCAGATGAGAAGGCAG | 2299 |
| CACNA2D1.1 | 68 | CAAACATTAGCTGGGCCTGTTCCATGGCATAACACTAAGGCGCAGACTCCTAAGGCACCCACTGGCTG | 2300 |
| CALD1.2 | 78 | CACTAAGGTTTGAGACAGTTCCAGAAAGAACCCAAGCTCAAGACGCAGGACGAGCTCAGTTGTAGAGGGCTAATTCGC | 2301 |
| CASP1.1 | 77 | AGAAAGCCCACATAGAGAAGGATTTTATCGCTTTCTGCTCTTCCACACCAGATAATGTTTCTTGGAGACATCCCACA | 2302 |
| CASP10.1 | 66 | ACCTTTCTCTTGGCCGGATGTCCTCAGGGCTGGCAGATGCAGTAGACTGCAGTGGACAGTCCCCAC | 2303 |
| CASP6.1 | 67 | CCTCACACTGGTGAACAGGAAAGTTTCTCAGCGCCGAGTGGACTTTTGCAAAGACCCAAGTGCAATT | 2304 |
| Caspase 3.1 | 66 | TGAGCCTGAGCAGAGACATGACTCAGCCTGTTCCATGAAGGCAGAGCCATGGACCACGCAGGAAGG | 2305 |
| CAT.1 | 78 | ATCCATTCGATCTCACCAAGGTTTGGCCTCACAAGGACTACCCTCTCATCCCAGTTGGTAAACTGGTCTTAAACCGGA | 2306 |
| CAV1.1 | 74 | GTGGCTCAACATTGTGTTCCCATTTCAGCTGATCAGTGGGCCTCCAAGGAGGGGCTGTAAAATGGAGGCCATTG | 2307 |
| CAV2.1 | 66 | CTTCCCTGGGACGACTTGCCAGCTCTGAGGCATGACAGTACGGGCCCCCAGAAGGGTGACCAGGAG | 2308 |
| CCL18.1 | 68 | GCTCCTGTGCACAAGTTGGTACCAACAAAGAGCTCTGCTGCCTCGTCTATACCTCCTGGCAGATTCCA | 2309 |
| CCL19.1 | 78 | GAACGCATCATCCAGAGACTGCAGAGGACCTCAGCCAAGATGAAGCGCCGCAGCAGTTAACCTATGACCGTGCAGAGG | 2310 |
| CCL20.1 | 69 | CCATGTGCTGTACCAAGAGTTTGCTCCTGGCTGCTTTGATGTCAGTGCTGCTACTCCACCTCTGCGGCG | 2311 |
| CCL4.2 | 70 | GGGTCCAGGAGTACGTGTATGACCTGGAACTGAACTGAGCTGCTCAGAGACAGGAAGTCTTCAGGGAAGG | 2312 |
| CCL5.2 | 65 | AGGTTCTGAGCTCTGGCTTTGCCTTGGCTTTGCCAGGGCTCTGTGACCAGGAAGGAAGTCAGCAT | 2313 |
| CCNB1.2 | 84 | TTCAGGTTGTTGCAGGAGACCATGTACATGACTGTCTCCATTATTGATCGGTTCATGCAGAATAATTGTGTGCCCAAGAAGATG | 2314 |
| CCND1.3 | 69 | GCATGTTCGTGGCCTCTAAGATGAAGGAGACCATCCCCCTGACGGCCGAGAAGCTGTGCATCTACACCG | 2315 |
| CCNE1.1 | 71 | AAAGAAGATGATGACCGGGTTTACCCAAACTCAACGTGCAAGCCTCGGATTATTGCACCATCCAGAGGCTC | 2316 |
| CCNE2 variant 1.1 | 85 | GGTCACCAAGAAACATCAGTATGAAATTAGGAATTGTTGGCCACCTGTATTATCTGGGGGGATCAGTCCTTGCATTATCATTGAA | 2317 |
| CCNE2.2 | 82 | ATGCTGTGGCTCCTTCCTAACTGGGGCTTTCTTGACATGTAGGTTGCTTGGTAATAACCTTTTTGTATATCACAATTTGGGT | 2318 |
| CCR1.1 | 66 | TCCAAGACCCAATGGGAATTCACTCACCACACCTGCAGCCTTCACTTTCCTCACGAAAGCCTACGA | 2319 |
| CCR2.1 | 67 | CTCGGGAATCCTGAAAACCCTGCTTCGGTGTCGAAACGAGAAGAAGAGGCATAGGGCAGTGAGAGTC | 2320 |
| CCR4.2 | 82 | AGACCCTGGTGGAGCTAGAAGTCCTTCAGGACTGCACCTTTGAAAGATACTTGGACTATGCCATCCAGGCCACAGAAACTCT | 2321 |
| CCR5.1 | 67 | CAGACTGAATGGGGTGGGGGGGCGCCTTAGGTACTTATTCCAGATGCCTTCTCCAGACAAACCAG | 2322 |

TABLE B-continued

| Gene | Target Sequence Length | Amplicon Sequence | SEQ ID NO. |
|---|---|---|---|
| CCR7.1 | 64 | GGATGACATGCACTCAGCTCTTGGCTCCACTGGGATGGGAGGAGAGGACAAGGGAAATGTCAGG | 2323 |
| CD105.1 | 75 | GCAGGTGTCAGCAAGTATGATCAGCAATGAGGCGGTGGTCAATATCCTGTCGAGCTCATCACCACAGCGGAAAAA | 2324 |
| CD14.1 | 66 | GTGTGCTAGCGTACTCCCGCCTCAAGGAACTGACGCTCGAGGACCTAAAGATAACCGGCACCATGC | 2325 |
| CD18.2 | 81 | CGTCAGGACCCACCATGTCTGCCCCATCACGCGGCCGAGACATGGCTTGGCCACAGCTCTTGAGGATGTCACCAATTAACC | 2326 |
| CD1A.1 | 78 | GGAGTGGAAGGAACTGGAAACATTATTCCGTATACGCACCATTCGGTCATTTGAGGGAATTCGTAGATACGCCCATGA | 2327 |
| CD24.1 | 77 | TCCAACTAATGCCACCACCAAGGCGGCTGGTGGTGCCCTGCAGTCAACAGCCAGTCTCTTCGTGGTCTCACTCTCTC | 2328 |
| CD274.2 | 69 | GCTGCATGATCAGCTATGGTGGTGCCGACTACAAGCGAATTACTGTGAAAGTCAATGCCCCATACAACA | 2329 |
| CD31.3 | 75 | TGTATTTCAAGACCTCTGTGCACTTATTTATGAACCTGCCCTGCTCCCACAGAACACAGCAATTCCTCAGGCTAA | 2330 |
| CD34.1 | 67 | CCACTGCACACACCTCAGAGGCTGTTCTTGGGGCCCTACACCTTGAGGAGGGGCAGGTAAACTCCTG | 2331 |
| CD36.1 | 67 | GTAACCCAGGACGCTGAGGACAACACAGTCTCTTTCCTGCAGCCCAATGGTGCCATCTTCGAACCTT | 2332 |
| CD3z.1 | 65 | AGATGAAGTGGAAGGCGCTTTTCACCGCGGCCATCCTGCAGGCACAGTTGCCGATTACAGAGGCA | 2333 |
| CD4.1 | 67 | GTGCTGGAGTCGGGACTAACCCAGGTCCCTTGTCCCAAGTTCCACTGCTGCCTCTTGAATGCAGGGA | 2334 |
| CD44.1 | 67 | GGCACCACTGCTTATGAAGGAAACTGGAACCCAGAAGCACACCCTCCCCTCATTCACCATGAGCATC | 2335 |
| CD44s.1 | 78 | GACGAAGACAGTCCCTGGATCACCGACAGCACAGACAGAATCCCTGCTACCAGAGACCAAGACACATTCCACCCCAGT | 2336 |
| CD44v6.1 | 78 | CTCATACCAGCCATCCAATGCAAGGAAGGACAACACCAAGCCCAGAGGACAGTTCCTGGACTGATTTCTTCAACCCAA | 2337 |
| CD53.1 | 72 | CGACAGCATCCACCGTTACCACTCAGACAATAGCACCAAGGCAGCGTGGGACTCCATCCAGTCATTTCTGCA | 2338 |
| CD68.2 | 74 | TGGTTCCCAGCCCTGTGTCCACCTCCAAGCCCAGATTCAGATTCGAGTCATGTACACAACCCAGGGTGGAGGAG | 2339 |
| CD82.3 | 84 | GTGCAGGCTCAGGTGAAGTGCTGCGGCTGGGTCAGCTTCTACAACTGGACAGACAACGCTGAGCTCATGAATCGCCCTGAGGTC | 2340 |
| CD8A.1 | 68 | AGGGTGAGGTGCTTGAGTCTCCAACGGCAAGGGAACAAGTACTTCTTGATACCTGGGATACTGTGCCC | 2341 |
| CD99.1 | 77 | GTTCCTCCGGTAGCTTTTCAGATGCTGACCTTGCGGATGGCGTTTCAGGTGGAGAAGGAAAGGAGGCAGTGATGGT | 2342 |
| cdc25A.4 | 71 | TCTTGCTGGCTACGCCTCTTCTGTCCCTGTTAGACGTCCTCCGTCCATATCAGAACTGTGCCACAATGCAG | 2343 |
| CDC25B.1 | 85 | AAACGAGCAGTTTGCCATCAGACGCTTCCAGTCTATGCCGGTGAGGCTGCTGGGCCACAGCCCCGTGCTTCGGAACATCACCAAC | 2344 |
| CDH1.3 | 81 | TGAGTGTCCCCCGGTATCTTCCCCGCCCTGCCAATCCCGATGAAATTGGAAATTTTATTGATGAAATCTGAAAGCGGCTG | 2345 |
| CDH13.1 | 67 | GCTACTTCTCCACTGTCCCGTTCAGTCTGAATGCTGCCACAACCAGCCAGGCAGGTCCACAGAGAGG | 2346 |
| CDH16.1 | 67 | GACTGTCTGAATGGCCCAGGCAGCTCTAGCTGGGAGCTTGGCCTCTGGCTCCATCTGAGTCCCTGG | 2347 |

TABLE B-continued

| Gene | Target Sequence Length | Amplicon Sequence | SEQ ID NO. |
|---|---|---|---|
| CDH2.1 | 66 | TGACCGATAAGGATCAACCCCATACACCAGCCTGGAACGCAGTGTACAGAATCAGTGGCGGAGATC | 2348 |
| CDH5.1 | 67 | ACAGGAGACGTGTTCGCCATTGAGAGGCTGGACCGGGAGAATATCTCAGAGTACCACCTCACTGCTG | 2349 |
| CDH6.1 | 66 | ACACAGGCGACATACAGGCCACCAAGAGGCTGGACAGGGAAGAAAAACCCGTTTACATCCTTCGAG | 2350 |
| CDK4.1 | 66 | CCTTCCCATCAGCACAGTTCGTGAGGTGGCTTTACTGAGGCGACTGGAGGCTTTTGAGCATCCCAA | 2351 |
| CDK6.1 | 67 | AGTGCCCTGTCTCACCCATACTTCCAGGACCTGGAAAGGTGCAAAGAAAACCTGGATTCCCACCTGC | 2352 |
| CDKN2A.2 | 79 | AGCACTCACGCCCTAAGCGCACATTCATGTGGGCATTTCTTGCGAGCCTCGCAGCCTCCGGAAGCTGTCGACTTCATGA | 2353 |
| CEACAM1.1 | 71 | ACTTGCCTGTTCAGAGCACTCATTCCTTCCCACCCCCAGTCCTGTCCTATCACTCTAATTCGGATTTGCCA | 2354 |
| CEBPA.1 | 66 | TTGGTTTTGCTCGGATACTTGCCAAAATGAGACTCTCCGTCGGCAGCTGGGGAAGGGTCTGAGAC | 2355 |
| CENPF.1 | 68 | CTCCCGTCAACAGCGTTCTTTCCAAACACTGGACCAGGAGTGCATCCAGATGAAGGCCAGACTCACCC | 2356 |
| CFLAR.1 | 66 | GGACTTTTGTCCAGTGACAGCTGAGACAACAAGGACCACGGGAGGAGGTGTAGGAGAGAAGCGCCG | 2357 |
| CGA (CHGA official).1 | 76 | CTGAAGGAGCTCCAAGACCTCGCTCTCCAAGGCGCCAAGGAGAGGGCACATCAGCAGAAGAAACACAGCGGTTTTG | 2358 |
| Chk1.2 | 82 | GATAAATTGGTACAAGGGATCAGCTTTTCCCAGCCCACATGTCCTGATCATATGCTTTTGAATAGTCAGTTACTTGGCACCC | 2359 |
| Chk2.3 | 78 | ATGTGGAACCCCCACCTACTTGGCGCCTGAAGTTCTTGTTTCTGTTGGGACTGCTGGGTATAACCGTGCTGTGGACTG | 2360 |
| CIAP1.2 | 72 | TGCCTGTGGTGGGAAGCTCAGTAACTGGGAACCAAAGGATGATGCTATGTCAGAACACCGGAGGCATTTTCC | 2361 |
| cIAP2.2 | 86 | GGATATTTCCGTGGCTCTTATTCAAACTCTCCATCAAATCCTGTAAACTCCAGAGCAAATCAAGATTTTCTGCCTTGATGAGAAG | 2362 |
| CLCNKB.1 | 67 | GTGACCCTGAAGCTGTCCCCAGAGACTTCCCTGCATGAGGCACACAACCTCTTTGAGCTGTTGAACC | 2363 |
| CLDN10.1 | 66 | GGTCTGTGGATGAACTGCGCAGGTAACGCGTTGGGTTCTTTCCATTGCCGACCGCATTTTACTATC | 2364 |
| CLDN7.2 | 74 | GGTCTGCCCTAGTCATCCTGGGAGGTGCACTGCTCTCCTGTTCCTGTCCTGGGAATGAGAGCAAGGCTGGGTAC | 2365 |
| CLU.3 | 76 | CCCCAGGATACCTACCACTACCTGCCCCTTCAGCCTGCCCCACCGGAGGCCTCACTTCTTCTTTCCCAAGTCCCGCA | 2366 |
| cMet.2 | 86 | GACATTTCCAGTCCTGCAGTCAATGCCTCTCTGCCCCACCCTTTGTTCAGTGTGGCTGGTGCCACGACAAATGTGTGCGATCGGAG | 2367 |
| cMYC.3 | 84 | TCCCTCCACTCGGAAGGACTATCCTGCTGCCAAGAGGGTCAAGTTGGACAGTGTCAGAGTCCTGAGACAGATCAGCAACAACCG | 2368 |
| COL18A1.1 | 67 | AGCTGCCATCACGCCTACATCGTGCTCTGCATTGAGAACAGCTTCATGACTGCCTCCAAGTAGCCAC | 2369 |
| COL1A1.1 | 68 | GTGGCCATCCAGCTGACCTTCCTGCGCCTGATGTCCACCGAGGCCTCCCAGAACATCACCTACCACTG | 2370 |
| COL1A2.1 | 80 | CAGCCAAGAACTGGTATAGGAGCTCCAAGGACAAGAAACACGTCTGGCTAGGAGAAACTATCAATGCTGGCAGCCAGTTT | 2371 |
| COL4A1.1 | 66 | ACAAAGGCCTCCCAGGATTGGATGGCATCCCTGGTGTCAAAGGAGAAGCAGGTCTTCCTGGGACTC | 2372 |

TABLE B-continued

| Gene | Target Sequence Length | Amplicon Sequence | SEQ ID NO. |
|---|---|---|---|
| COL4A2.1 | 67 | CAACCCTGGTGATGTCTGCTACTATGCCAGCCGGAACGACAAGTCCTACTGGCTCTCTACCACTGCG | 2373 |
| COL5A2.2 | 72 | GGTCGAGGAACCCAAGGTCCGCCTGGTGCTACAGGATTTCCTGGTTCTGCGGGCAGAGTTGGACCTCCAGGC | 2374 |
| COL7A1.1 | 66 | GGTGACAAAGGACCTCGGGGAGACAATGGGGACCCTGGTGACAAGGGCAGCAAGGGAGAGCCTGGT | 2375 |
| COX2.1 | 79 | TCTGCAGAGTTGGAAGCACTCTATGGTGACATCGATGCTGTGGAGCTGTATCCTGCCCTTCTGGTAGAAAAGCCTCGGC | 2376 |
| CP.1 | 73 | CGTGAGTACACAGATGCCTCCTTCACAAATCGAAAGGAGAGAGGCCCTGAAGAAGAGCATCTTGGCATCCTGG | 2377 |
| CPB2.1 | 67 | GGCACATACGGATTCTTGCTGCCGGAGCGTTACATCAAACCCACCTGTAGAGAAGCTTTTGCCGCTG | 2378 |
| CRADD.1 | 69 | GATGGTGCCTCCAGCAACCGCTGGGGAGTGTGTCCCTGAGTCATGTGGGCTGAATCCTGACTTTCACTC | 2379 |
| cripto (TDGF1 official | 65 | GGGTCTGTGCCCCATGACACCTGGCTGCCCAAGAAGTGTTCCCTGTGTAAATGCTGGCACGGTCA | 2380 |
| CRP.1 | 66 | GACGTGAACCACAGGGTGTCCTGTCAGAGGAGCCCATCTCCCATCTCCCCAGCTCCCTATCTGGAG | 2381 |
| CSF1.1 | 74 | TGCAGCGGCTGATTGACAGTCAGATGGAGACCTCGTGCCAAATTACATTTGAGTTTGTAGACCAGGAACAGTTG | 2382 |
| CSF1R.2 | 80 | GAGCACAACCAAACCTACGAGTGCAGGGCCCACAACAGCGTGGGGAGTGGCTCCTGGGCCTTCATACCCATCTCTGCAGG | 2383 |
| CSF2.1 | 76 | GAACCTGAAGGACTTTCTGCTTGTCATCCCCTTTGACTGCTGGGAGCCAGTCCAGGAGTGAGACCGGCCAGATGAG | 2384 |
| CSF2RA.2 | 67 | TACCACACCCAGCATTCCTCCTGATCCCAGAGAAATCGGATCTGCGAACAGTGGCACCAGCCTCTAG | 2385 |
| CSF3.2 | 79 | CCCAGGCCTCTGTGTCCTTCCCTGCATTTCTGAGTTTCATTCTCCTGCCTGTAGCAGTGAGAAAAAGCTCCTGTCCTCC | 2386 |
| CTGF.1 | 76 | GAGTTCAAGTGCCCTGACGGCGAGGTCATGAAGAAGAACATGATGTTCATCAAGACCTGTGCCTGCCATTACAACT | 2387 |
| CTSB.1 | 62 | GGCCGAGATCTACAAAAACGGCCCCGTGGAGGGAGCTTTCTCTGTGTATTCGGACTTCCTGC | 2388 |
| CTSD.2 | 80 | GTACATGATCCCCTGTGAGAAGGTGTCCACCCTGCCCGCGATCACACTGAAGCTGGGAGGCAAAGGCTACAAGCTGTCCC | 2389 |
| CTSH.2 | 77 | GCAAGTTCCAACCTGGAAAGGCCATCGGCTTTGTCAAGGATGTAGCCAACATCACAATCTATGACGAGGAAGCGATG | 2390 |
| CTSL.2 | 74 | GGGAGGCTTATCTCACTGAGTGAGCAGAATCTGGTAGACTGCTCTGGGCCTCAAGGCAATGAAGGCTGCAATGG | 2391 |
| CTSL2.1 | 67 | TGTCTCACTGAGCGAGCAGAATCTGGTGGACTGTTCGCGTCCTCAAGGCAATCAGGGCTGCAATGGT | 2392 |
| CTSS.1 | 76 | TGACAACGGCTTTCCAGTACATCATTGATAACAAGGGCATCGACTCAGACGCTTCCTATCCCTACAAAGCCATGGA | 2393 |
| CUBN.1 | 71 | GAGGCCGTTACTGTGGCACCGACATGCCCCATCCTATCACATCCTTCAGCAGCGCCCTGACGCTGAGATTC | 2394 |
| CUL1.1 | 71 | ATGCCCTGGTAATGTCTGCATTCAACAATGACGCTGGCTTTGTGGCTGCTCTTGATAAGGCTTGTGGTCGC | 2395 |
| CUL4A.1 | 75 | AAGCATCTTCCTGTTCTTGGACCGCACCTATGTGCTGCAGAACTCCACGCTGCCCTCCATCTGGGATATGGGATT | 2396 |
| CX3CL1.1 | 66 | GACCCTTGCCGTCTACCTGAGGGGCCTCTTATGGGCTGGGTTCTACCCAGGTGCTAGGAACACTCC | 2397 |

TABLE B-continued

| Gene | Target Sequence Length | Amplicon Sequence | SEQ ID NO. |
|---|---|---|---|
| CX3CR1.1 | 68 | TTCCCAGTTGTGACATGAGGAAGGATCTGAGGCTGGCCCTCAGTGTGACTGAGACGGTTGCATTTAGC | 2398 |
| CXCL10.1 | 68 | GGAGCAAAATCGATGCAGTGCTTCCAAGGATGGACCACACAGAGGCTGCCTCTCCCATCACTTCCCTA | 2399 |
| CXCL12.1 | 67 | GAGCTACAGATGCCCATGCCGATTCTTCGAAAGCCATGTTGCCAGAGCCAACGTCAAGCATCTCAAA | 2400 |
| CXCL14.1 | 74 | TGCGCCCTTTCCTCTGTACATATACCCTTAAGAACGCCCCCTCCACACACTGCCCCCCAGTATATGCCGCATTG | 2401 |
| CXCL9.1 | 70 | ACCAGACCATTGTCTCAGAGCAGGTGCTGGCTCTTTCCTGGCTACTCCATGTTGGCTAGCCTCTGGTAAC | 2402 |
| CXCR4.3 | 72 | TGACCGCTTCTACCCCAATGACTTGTGGGTGGTTGTGTTCCAGTTTCAGCACATCATGGTTGGCCTTATCCT | 2403 |
| CXCR6.1 | 67 | CAGAGCCTGACGGATGTGTTCCTGGTGAACCTACCCCTGGCTGACCTGGTGTTTGTCTGCACTCTGC | 2404 |
| CYP2C8.2 | 73 | CCGTGTTCAAGAGGAAGCTCACTGCCTTGTGGAGGAGTTGAGAAAAACCAAGGCTTCACCCTGTGATCCCACT | 2405 |
| CYP2C8v2.1 | 70 | GCTGTAGTGCACCAGATCCAGAGATACAGTGACCTTGTCCCCACCGGTGTGCCCCATGCAGTGACCACTG | 2406 |
| CYP3A4.2 | 79 | AGAACAAGGACAACATAGATCCTTACATATACACACCCTTTGGAAGTGGACCCAGAAACTGCATTGGCATGAGGTTTGC | 2407 |
| CYR61.1 | 76 | TGCTCATTCTTGAGGAGCATTAAGGTATTTCGAAACTGCCAAGGGTGCTGGTGCGGATGGACACTAATGCAGCCAC | 2408 |
| DAG1.1 | 67 | GTGACTGGGCTCATGCCTCCAAGTCAGAGTTTCCCTGGTGCCCCAGAGACAGGAGCACAAGTGGGAT | 2409 |
| DAPK1.3 | 77 | CGCTGACATCATGAATGTTCCTCGACCGGCTGGAGGCGAGTTTGGATATGACAAAGACACATCGTTGCTGAAAGAGA | 2410 |
| DCBLD2.1 | 69 | TCACCAGGGCAGGAAGTTTATCATGCCTATGCTGAACCACTCCCAATTACGGGGCCTGAGTATGCAACC | 2411 |
| DCC.3 | 75 | AAATGTCCTCCTCGACTGCTCCGCGGAGTCCGACCGAGGAGTTCCAGTGATCAAGTGGAAGAAAGATGGCATTCA | 2412 |
| DCN.1 | 67 | GAAGGCCACTATCATCCTCCTTCTGCTTGCACAAGTTTCCTGGGCTGGACCGTTTCAACAGAGAGGC | 2413 |
| DCXR.1 | 66 | CCATAGCGTCTACTGCTCCACCAAGGGTGCCCTGGACATGCTGACCAAGGTGATGGCCCTAGAGCT | 2414 |
| DDC.1 | 67 | CAGAGCCCAGACACCATGAACGCAAGTGAATTCCGAAGGAGAGGGAAGGAGATGGTGGATTACGTGG | 2415 |
| DEFB1.1 | 68 | GATGGCCTCAGGTGGTAACTTTCTCACAGGCCTTGGCCACAGATCTGATCATTACAATTGCGTCAGCA | 2416 |
| DET1.1 | 70 | CTTGTGGAGATCACCCAATCAGGTTCTATGCCCGGGACTCGGGCCTGCTCAAGTTTGAGATCCAGGCGGG | 2417 |
| DHPS.3 | 78 | GGGAGAACGGGATCAATAGGATCGGAAACCTGCTGGTGCCCAATGAGAATTACTGCAAGTTTGAGGACTGGCTGATGC | 2418 |
| DIABLO.1 | 73 | CACAATGGCGGCTCTGAAGAGTTGGCTGTCGCGCAGCGTAACTTCATTCTTCAGGTACAGACAGTGTTTGTGT | 2419 |
| DIAPH1.1 | 62 | CAAGCAGTCAAGGAGAACCAGAAGCGGCGGGAGACAGAAGAAAGATGAGGCGAGCAAAACT | 2420 |
| DICER1.2 | 68 | TCCAATTCCAGCATCACTGTGGAGAAAAGCTGTTTGTCTCCCCAGCATACTTTATCGCCTTCACTGCC | 2421 |
| DKFZP56400823.1 | 66 | CAGCTACACTGTCGCAGTCCGCTGCTGAGCCTCCCACACTCATCTCCCCTCAAGCTCCAGCCTCAT | 2422 |

TABLE B-continued

| Gene | Target Sequence Length | Amplicon Sequence | SEQ ID NO. |
|---|---|---|---|
| DLC1.1 | 68 | GATTCAGACGAGGATGAGCCTTGTGCCATCAGTGGCAAATGGACTTTCCAAAGGGACAGCAAGAGGTG | 2423 |
| DLL4.1 | 67 | CACGGAGGTATAAGGCAGGAGCCTACCTGGACATCCCTGCTCAGCCCCGCGGCTGGACCTTCCTTCT | 2424 |
| DPEP1.1 | 72 | GGACTCCAGATGCCAGGAGCCCTGCTGCCCACATGCAAGGACCAGCATCTCCTGAGAGGACGCCTGGGCTTA | 2425 |
| DPYS.1 | 70 | AAAGAATGGCACCATGCAGCCCACCATGTCATGGGTCCACCTTTGCGACCAGACCCCTCAACACCCGACT | 2426 |
| DR4.2 | 83 | TGCACAGAGGGTGTGGGTTACACCAATGCTTCCAACAATTTGTTTGCTTGCCTCCCATGTACAGCTTGTAAATCAGATGAAGA | 2427 |
| DR5.2 | 84 | CTCTGAGACAGTGCTTCGATGACTTTGCAGACTTGGTGCCCTTTGACTCCTGGGAGCCGCTCATGAGGAAGTTGGGCCTCATGG | 2428 |
| DUSP1.1 | 76 | AGACATCAGCTCCTGGTTCAACGAGGCCATTGACTTCATAGACTCCATCAAGAATGCTGGAGGAAGGGTGTTTGTC | 2429 |
| DUSP9.1 | 77 | CGTCCTAATCAACGTGCCTATGGCGGGACCACGCTCGGAGCCTGCCTCTTCTGCGACTGTTACTTTTTCTTTGCGGG | 2430 |
| E2F1.3 | 75 | ACTCCCTCTACCCTTGAGCAAGGGCAGGGGTCCCTGAGCTGTTCTTCTGCCCCATACTGAAGGAACTGAGGCCTG | 2431 |
| EBAG9.1 | 66 | CGCTCCTGTTTTTCTCATCTGTGCAGTGGGTTTTGATTCCCACCATGGCCATCACCCAGTTTCGGT | 2432 |
| ECRG4.1 | 66 | GCTCCTGCTCCTGTGCTGGGGCCCAGGTGGCATAAGTGGAAATAAACTCAAGCTGATGCTTCAAAA | 2433 |
| EDG2.1 | 72 | ACGAGTCCATTGCCTTCTTTTATAACCGAAGTGGAAAGCATCTTGCCACAGAATGGAACACAGTCAGCAAGC | 2434 |
| EDN1 endothelin.1 | 73 | TGCCACCTGGACATCATTTGGGTCAACACTCCCGAGCACGTTGTTCCGTATGGACTTGGAAGCCCTAGGTCCA | 2435 |
| EDN2.1 | 79 | CGACAAGGAGTGCGTCTACTTCTGCCACTTGGACATCATCTGGGTGAACACTCCTGAACAGACAGCTCCTTACGGCCTG | 2436 |
| EDNRA.2 | 76 | TTTCCTCAAATTTGCCTCAAGATGGAAACCCTTTGCCTCAGGGCATCCTTTTGGCTGGCACTGGTTGGATGTGTAA | 2437 |
| EDNRB.1 | 72 | ACTGTGAACTGCCTGGTGCAGTGTCCACATGACAAAGGGGCAGGTAGCACCCTCTCTCACCCATGCTGTGGT | 2438 |
| EEF1A1.1 | 67 | CGAGTGGAGACTGGTGTTCTCAAACCCGGTATGGTGGTCACCTTTGCTCCAGTCAACGTTACAACGG | 2439 |
| EFNB1.2 | 66 | GGAGCCCGTATCCTGGAGCTCCCTCAACCCCAAGTTCCTGAGTGGGAAGGGCTTGGTGATCTATCC | 2440 |
| EFNB2.1 | 73 | TGACATTATCATCCCGCTAAGGACTGCGGACAGCGTCTTCTGCCCTCACTACGAGAAGGTCAGCGGGGACTAC | 2441 |
| EGF.3 | 84 | CTTTGCCTTGCTCTGTCACAGTGAAGTCAGCCAGAGCAGGGCTGTTAAACTCTGTGAAATTTGTCATAAGGGTGTCAGGTATTT | 2442 |
| EGFR.2 | 62 | TGTCGATGGACTTCCAGAACCACCTGGGCAGCTGCCAAAAGTGTGATCCAAGCTGTCCCAAT | 2443 |
| EGLN3.1 | 68 | GCTGGTCCTCTACTGCGGGAGCCGGCTGGGCAAATACTACGTCAAGGAGAGGTCTAAGGCAATGGTGG | 2444 |
| EGR1.1 | 76 | GTCCCCGCTGCAGATCTCTGACCCGTTCGGATCCTTTCCTCACTCGCCCACCATGGACAACTACCCTAAGCTGGAG | 2445 |
| EIF2C1.1 | 67 | CCCTCACGGACTCTCAGCGCGTTCGCTTCACCAAGGAGATCAAGGGCCTGAAGGTGGAAGTCACCCA | 2446 |
| EIF4EBP1.1 | 66 | GGCGGTGAAGAGTCACAGTTTGAGATGGACATTTAAAGCACCAGCCATCGTGTGGAGCACTACCAA | 2447 |

TABLE B-continued

| Gene | Target Sequence Length | Amplicon Sequence | SEQ ID NO. |
|---|---|---|---|
| ELTD1.1 | 66 | AGGTCTTGTGCAAGAGGAGCCCTCGCTCTTCTGTTCCTTCTCGGCACCACCTGGATCTTTGGGGTT | 2448 |
| EMCN.1 | 73 | AGGCACTGAGGGTGGAAAAAATGCAAGCACTTCAGCAACCAGCCGGTCTTATTCCAGTATTATTTTGCCGGTG | 2449 |
| EMP1.1 | 75 | GCTAGTACTTTGATGCTCCCTTGATGGGGTCCAGAGAGCCTCCCTGCAGCCACCAGACTTGGCCTCCAGCTGTTC | 2450 |
| ENO2.1 | 67 | TCCTTGGCTTACCTGACCTCTTGCTGTCTCTGCTCGCCCTCCTTTCTGTGCCCTACTCATTGGGGTT | 2451 |
| ENPEP.1 | 67 | CACCTACACGGAGAACGGACAAGTCAAGAGCATAGTGGCCACCGATCATGAACCAACAGATGCCAGG | 2452 |
| ENPP2.1 | 67 | CTCCTGCGCACTAATACCTTCAGGCCAACCATGCCAGAGGAAGTTACCAGACCCAATTATCCAGGGA | 2453 |
| EPAS1.1 | 72 | AAGCCTTGGAGGGTTTCATTGCCGTGGTGACCCAAGATGGCGACATGATCTTTCTGTCAGAAAACATCAGCA | 2454 |
| EPB41L3.1 | 66 | TCAGTGCCATACGCTCTCACTCTCTCCTTCCCTCTGGCTCTGTGCCTCTGCTACCTGGAGCCCAAG | 2455 |
| EPHA2.1 | 72 | CGCCTGTTCACCAAGATTGACACCATTGCGCCCGATGAGATCACCGTCAGCAGCGACTTCGAGGCACGCCAC | 2456 |
| EPHB1.3 | 67 | CCTTGGGAGGGAAGATCCCTGTGAGATGGACAGCTCCAGAGGCCATCGCCTACCGCAAGTTCACTTC | 2457 |
| EPHB2.1 | 66 | CAACCAGGCAGCTCCATCGGCAGTGTCCATCATGCATCAGGTGAGCCGCACCGTGGACAGCATTAC | 2458 |
| EPHB4.1 | 77 | TGAACGGGGTATCCTCCTTAGCCACGGGGCCCGTCCCATTTGAGCCTGTCAATGTCACCACTGACCGAGAGGTACCT | 2459 |
| EPO.1 | 84 | CAGTGCCAGCAATGACATCTCAGGGGCCAGAGGAACTGTCCAGAGAGCAACTCTGAGATCTAAGGATGTCACAGGGCCAACTTG | 2460 |
| ErbB3.1 | 81 | CGGTTATGTCATGCCAGATACACACCTCAAAGGTACTCCCTCCTCCCGGGAAGGCACCCTTTCTTCAGTGGGTCTCAGTTC | 2461 |
| ERBBR.3 | 86 | TGGCTCTTAATCAGTTTCGTTACCTGCCTCTGGAGAATTTACGCATTATTCGTGGGACAAAACTTTATGAGGATCGATATGCCTTG | 2462 |
| ERCC1.2 | 67 | GTCCAGGTGGATGTGAAAGATCCCCAGCAGGCCCTCAAGGAGCTGGCTAAGATGTGTATCCTGGCCG | 2463 |
| ERCC4.1 | 67 | CTGCTGGAGTACGAGCGACAGCTGGTGCTGGAACTGCTCGACACTGACGGGCTAGTAGTGTGCGCCCC | 2464 |
| EREG.1 | 91 | ATAACAAAGTGTAGCTCTGACATGAATGGCTATTGTTTGCATGGACAGTGCATCTATCTGGTGGACATGAGTCAAAACTACTGCAGGTGTG | 2465 |
| ERG.1 | 70 | CCAACACTAGGCTCCCCACCAGCCATATGCCTTCTCATCTGGGCACTTACTACTAAAGACCTGGCGGAGG | 2466 |
| ERK1.3 | 67 | ACGGATCACAGTGGAGGAAGCGCTGGCTCACCCCTACCTGGAGCAGTACTATGACCCGACGGATGAG | 2467 |
| ERK2.3 | 68 | AGTTCTTGACCCCTGGTCCTGTCTCCAGCCCGTCTTGGCTTATCCACTTTGACTCCTTTGAGCCGTTT | 2468 |
| ESPL1.3 | 70 | ACCCCCAGACCGGATCAGGCAAGCTGGCCCTCATGTCCCCTTCACGGTGTTTGAGGAAGTCTGCCCTACA | 2469 |
| ESRRG.3 | 67 | CCAGCACCATTGTTGAAGATCCCCAGACCAAGTGTGAATACATGCTCAACTCGATGCCCAAGAGACT | 2470 |
| F2.1 | 77 | GCTGCATGTCTGGAAGGTAACTGTGCTGAGGGTCTGGGTACGAACTACCGAGGGCATGAAACATCACCCGGTCAGG | 2471 |
| F3.1 | 73 | GTGAAGGATGTGAAGCAGACGTACTTGGCACGGGTCTTCTCCTACCCGGCAGGGAATGTGGAGAGCACCGGTT | 2472 |

TABLE B-continued

| Gene | Target Sequence Length | Amplicon Sequence | SEQ ID NO. |
|---|---|---|---|
| FABP1.1 | 66 | GGGTCCAAAGTGATCCAAAACGAATTCACGGTGGGGGAGGAATGTGAGCTGGAGACAATGACAGGG | 2473 |
| FABP7.1 | 72 | GGAGACAAAGTGGTCATCAGGACTCTCAGCACATTCAAGAACACGGAGATTAGTTTCCAGCTGGGAGAAGAG | 2474 |
| FAP.1 | 66 | CTGACCAGAACCACGGCTTATCCGGCCTGTCCACGAACCACTTATACACCCACATGACCCACTTCC | 2475 |
| fas.1 | 91 | GGATTGCTCAACAACCATGCTGGGCATCTGGACCCTCCTACCTCTGGTTCTTACGTCTGTTGCTAGATTATCGTCCAAAAGTGTTAATGCC | 2476 |
| fasl.2 | 80 | GCACTTTGGGATTCTTTCCATTATGATTCTTTGTTACAGGCACCGAGAATGTTGTATTCAGTGAGGGTCTTCTTACATGC | 2477 |
| FBXW7.1 | 73 | CCCCAGTTTCAACGAGACTTCATTTCATTGCTCCCTAAAGAGTTGGCACTCTATGTGCTTTCATTCCTGGAAC | 2478 |
| FCER1G.2 | 73 | TGCCATCCTGTTTCTGTATGGAATTGTCCTCACCCTCCTCTACTGTCGACTGAAGATCCAAGTGCGAAAGGCA | 2479 |
| FCGR3A.1 | 67 | GTCTCCAGTGGAAGGGAAAAGCCCATGATCTTCAAGCAGGGAAGCCCCAGTGAGTAGCTGCATTCCT | 2480 |
| FDPS.1 | 77 | GGATGATTACCTTGACCTCTTTGGGGACCCCAGTGTGACCGGCAAAATTGGCACTGACATCCAGGACAACAAATGCA | 2481 |
| FEN1.1 | 66 | GTGGAGAAGGGTACGCCAGGGTCGCTGAGAGACTCTGTTCTCCCTGGAGGGACTGGTTGCCATGAG | 2482 |
| FGF1.1 | 66 | GACACCGACGGGCTTTTATACGGCTCACAGACACCAAATGAGGAATGTTTGTTCCTGGAAAGGCTG | 2483 |
| FGF2.2 | 76 | AGATGCAGGAGAGAGGAAGCCTTGCAAACCTGCAGACTGCTTTTTGCCCAATATAGATTGGGTAAGGCTGCAAAAC | 2484 |
| FGF9.1 | 67 | CACAGCTGCCATACTTCGACTTATCAGGATTCTGGCTGGTGGCCTGCGCGAGGGTGCAGTCTTACTT | 2485 |
| FGFR1.3 | 74 | CACGGGACATTCACCACATCGACTACTATAAAAAGACAACCAACGGCCGACTGCCTGTGAAGTGGATGGCACCC | 2486 |
| FGFR2 isoform 1.1 | 80 | GAGGGACTGTTGGCATGCAGTGCCCTCCCAGAGACCAACGTTCAAGCAGTTGGTAGAAGACTTGGATCGAATTCTCACTC | 2487 |
| FH.1 | 67 | ATGGTTGCAGCCCAAGTCATGGGGAACCATGTTGCTGTCACTGTCGGAGGCAGCAATGGACATTTTG | 2488 |
| FHIT.1 | 67 | CCAGTGGAGCGCTTCCATGACCTGCGTCCTGATGAAGTGGCCGATTTGTTTCAGACGACCCAGAGAG | 2489 |
| FHL1.1 | 66 | ATCCAGCCTTTGCCGAATACATCCTATCTGCCACACATCCAGCGTGAGGTCCCTCCAGCTACAAGG | 2490 |
| FIGF.1 | 72 | GGTTCCAGCTTTCTGTAGCTGTAAGCATTGGTGGCCACACCACCTCCTTACAAAGCAACTAGAACCTGCGGC | 2491 |
| FILIP1.1 | 66 | ACACCGGTCACAACGTCATCTGCTCGAGGAACCCAGTCAGTGTCAGGACAAGACGGGTCATCCCAG | 2492 |
| FKBP1A.1 | 76 | CTGCCCTGACTGAATGTGTTCTGTCACTCAGCTTTGCTTCCGACACCTCTGTTTCCTCTTCCCCTTTCTCCTCGTA | 2493 |
| FLJ22655.1 | 82 | CTCCTTCACACAGAACCTTTCATTTATTGTACAACATCACACTCACCCTAACCTACTGGCGGACAGCGATCCCAGTTTGCCT | 2494 |
| FLT1.1 | 75 | GGCTCCTGAATCTATCTTTGACAAAATCTACAGCACCAAGAGCGACGTGTGGTCTTACGGAGTATTGCTGTGGGA | 2495 |
| FLT3LG.1 | 71 | TGGGTCCAAGATGCAAGGCTTGCTGGAGCGCGTGAACACGGAGATACACTTTGTCACCAAATGTGCCTTTC | 2496 |
| FLT4.1 | 69 | ACCAAGAAGCTGAGGACCTGTGGCTGAGCCCGCTGACCATGGAAGATCTTGTCTGCTACAGCTTCCAGG | 2497 |

TABLE B-continued

| Gene | Target Sequence Length | Amplicon Sequence | SEQ ID NO. |
|---|---|---|---|
| FN1.1 | 69 | GGAAGTGACAGACGTGAAGGTCACCATCATGTGGACACCGCCTGAGAGTGCAGTGACCGGCTACCGTGT | 2498 |
| FOLR1.1 | 67 | GAACGCCAAGCACCACAAGGAAAAGCCAGGCCCCGAGGACAAGTTGCATGAGCAGTGTCGACCCTGG | 2499 |
| FOS.1 | 67 | CGAGCCCTTTGATGACTTCCTGTTCCCAGCATCATCCAGGCCCAGTGGCTCTGAGACAGCCCGCTCC | 2500 |
| FRAP1.1 | 66 | AGCGCTAGAGACTGTGGACCGCCTGACGGAGTCCCTGGATTTCACTGACTATGCCTCCCGGATCAT | 2501 |
| FRP1.3 | 75 | TTGGTACCTGTGGGTTAGCATCAAGTTCTCCCCAGGGTAGAATTCAATCAGAGCTCCAGTTTGCATTTGGATGTG | 2502 |
| FST.1 | 72 | GTAAGTCGGATGAGCCTGTCTGTGCCAGTGACAATGCCACTTATGCCAGCGAGTGTGCCATGAAGGAAGCTG | 2503 |
| FZD2.2 | 78 | TGGATCCTCACCTGGTCGGTGCTGTGCTGCGCTTCCACCTTCTTCACTGTCACCACGTACTTGGTAGACATGCAGCGC | 2504 |
| G-Catenin.1 | 68 | TCAGCAGCAAGGGCATCATGGAGGAGGATGAGGCCTGCGGGCGCCAGTACACGCTCAAGAAAACCACC | 2505 |
| GADD45B.1 | 70 | ACCCTCGACAAGACCACACTTTGGGACTTGGGAGCTGGGGCTGAAGTTGCTCTGTACCCATGAACTCCCA | 2506 |
| GAS2.1 | 68 | AACATGTCATGGTCCGTGTGGGAGGAGGCTGGGAAACTTTTGCAGGGTATTTGTTGAAACACGACCCC | 2507 |
| GATA3.3 | 75 | CAAAGGAGCTCACTGTGGTGTCTGTGTTCCAACCACTGAATCTGGACCCCATCTGTGAATAAGCCATTCTGACTC | 2508 |
| GATM.1 | 67 | GATCTCGGCTTGGACGAACCTTGACAGGATGGGTGCAGCGAACTTTCCAGAGCACCCAGGCAGCTAC | 2509 |
| GBL.1 | 66 | GCTGTCAATAGCACCGGAAACTGCTATGTCTGGAATCTGACGGGGGCATTGGTGACGAGGTGACC | 2510 |
| GBP2.2 | 83 | GCATGGGAACCATCAACCAGCAGGCCATGGACCAACTTCACTATGTGACAGAGCTGACAGATCGAATCAAGGCAAACTCCTCA | 2511 |
| GCLC.3 | 71 | CTGTTGCAGGAAGGCATTGATCATCTCCTGGCCCAGCATGTTGCTCATCTCTTTATTAGAGACCCACTGAC | 2512 |
| GCLM.2 | 85 | TGTAGAATCAAACTCTTCATCATCAACTAGAAGTGCAGTTGACATGGCCTGTTCAGTCCTTGGAGTTGCACAGCTGGATTCTGTG | 2513 |
| GFRA1.1 | 69 | TCCGGGTTAAGAACAAGCCCCTGGGGCCAGCAGGGTCTGAGAATGAAATTCCCACTCATGTTTTGCCAC | 2514 |
| GJA1.1 | 68 | GTTCACTGGGGGTGTATGGGGTAGATGGGTGGAGAGGGAGGGGATAAGAGAGGTGCATGTTGGTATTT | 2515 |
| GLYAT.1 | 68 | TACCATTGCAAGGTGCCCAGATGCTGCAGATGCTGGAGAAATCCTTGAGGAAGAGCCTCCCAGCATCC | 2516 |
| GMNN.1 | 67 | GTTCGCTACGAGGATTGAGCGTCTCCACCCAGTAAGTGGGCAAGAGGCGGCAGGAAGTGGGTACGCA | 2517 |
| GNAS.1 | 72 | GAACGTGCCTGACTTTGACTTCCCTCCCGAATTCTATGAGCATGCCAAGGCTCTGTGGGAGGATGAAGGAGT | 2518 |
| GPC3.1 | 68 | TGATGCGCCTGGAAACAGTCAGCAGGCAACTCCGAAGGACAACGAGATAAGCACCTTTCACAACCTCG | 2519 |
| GPX1.2 | 67 | GCTTATGACCGACCCCAAGCTCATCACCTGGTCTCCGGTGTGTCGCAACGATGTTGCCTGGAACTTT | 2520 |
| GPX2.2 | 75 | CACACAGATCTCCTACTCCATCCAGTCCTGAGGAGCCTTAGGATGCAGCATGCCTTCAGGAGACACTGCTGGACC | 2521 |
| GPX3.1 | 69 | GCTCTAGGTCCAATTGTTCTGCTCTAACTGATACCTCAACCTTGGGGCCAGCATCTCCCACTGCCTCCA | 2522 |

TABLE B-continued

| Gene | Target Sequence Length | Amplicon Sequence | SEQ ID NO. |
|---|---|---|---|
| GRB14.1 | 76 | TCCCACTGAAGCCCTTTCAGTTGCGGTTGAAGAAGACTCGCTTGGAGGAAAAAAGGATGTT TACGCCTGGGCACT | 2523 |
| GRB7.2 | 67 | CCATCTGCATCCATCTTGTTTGGGCTCCCCACCCTTGAGAAGTGCCTCAGATAATACCCTG GTGGCC | 2524 |
| GRO1.2 | 73 | CGAAAAGATGCTGAACAGTGACAAATCCAACTGACCAGAAGGGAGGAGGAAGCTCACTGGT GGCTGTTCCTGA | 2525 |
| GSTM1.1 | 86 | AAGCTATGAGGAAAAGAAGTACACGATGGGGGACGCTCCTGATTATGACAGAAGCCAGTGG CTGAATGAAAAATTCAAGCTGGGCC | 2526 |
| GSTM3.2 | 76 | CAATGCCATCTTGCGCTACATCGCTCGCAAGCACAACATGTGTGGTGAGACTGAAGAAGAA AAGATTCGAGTGGAC | 2527 |
| GSTp.3 | 76 | GAGACCCTGCTGTCCCAGAACCAGGGAGGCAAGACCTTCATTGTGGGAGACCAGATCTCCT TCGCTGACTACAACC | 2528 |
| GSTT1.3 | 66 | CACCATCCCCACCCTGTCTTCCACAGCCGCCTGAAAGCCACAATGAGAATGATGCACACTG AGGCC | 2529 |
| GZMA.1 | 79 | GAAAGAGTTTCCCTATCCATGCTATGACCCAGCCACACGCGAAGGTGACCTTAAACTTTTA CAGCTGACGGAAAAAGCA | 2530 |
| HADH.1 | 66 | CCACCAGACAAGACCGATTCGCTGGCCTCCATTTCTTCAACCCAGTGCCTGTCATGAAACT TGTGG | 2531 |
| HAVCR1.1 | 76 | CCACCCAAGGTCACGACTACTCCAATTGTCACAACTGTTCCAACCGTCACGACTGTTCGAA CGAGCACCACTGTTC | 2532 |
| HADC1.1 | 74 | CAAGTACCACAGCGATGACTACATTAAATTCTTGCGCTCCATCCGTCCAGATAACATGTCG GAGTACAGCAAGC | 2533 |
| Hepsin.1 | 84 | AGGCTGCTGGAGGTCATCTCCGTGTGTGATTGCCCCAGAGGCCGTTTCTTGGCCGCCATCT GCCAAGACTGTGGCCGCAGGAAG | 2534 |
| HER2.3 | 70 | CGGTGTGAGAAGTGCAGCAAGCCCTGTGCCCGAGTGTGCTATGGTCTGGGCATGGAGCACT TGCGAGAGG | 2535 |
| HGD.1 | 76 | CTCAGGTCTGCCCCTACAATCTCTATGCTGAGCAGCTCTCAGGATCGGCTTTCACTTGTCC ACGGAGCACCAATAA | 2536 |
| HGF.4 | 65 | CCGAAATCCAGATGATGATGCTCATGGACCCTGGTGCTACACGGGAAATCCACTCATTCCT TGGG | 2537 |
| HGFAC.1 | 72 | CAGGACACAAGTGCCAGATTGCGGGCTGGGGCCACTTGGATGAGAACGTGAGCGGCTACTC CAGCTCCCTGC | 2538 |
| HIF1A.3 | 82 | TGAACATAAAGTCTGCAACATGGAAGGTATTGCACTGCACAGGCCACATTCACGTATATGA TACCAACAGTAACCAACCTCA | 2539 |
| HIF1AN.1 | 66 | TGTTGGCCAGGTCTCACTGCAGCCTGCCCGAGGCTAACTGGCTAGAGCCTCCAGGCCCTAT GATGC | 2540 |
| HIST1H1D.1 | 67 | AAAAAGGCGAAGAAGGCAGGCGCAACTGCTGGGAAACGCAAAGCATCCGGACCCCCAGTAT CTGAGC | 2541 |
| HLA-B.1 | 78 | CTTGTGAGGGACTGAGATGCAGGATTTCTTCACGCCTCCCCTTTGTGACTTCAAGAGCCTC TGGCATCTCTTTCTGCA | 2542 |
| HLA-DPA1.1 | 78 | CGCCCTGAAGACAGAATGTTCCATATCAGAGCTGTGATCTTGAGAGCCCTCTCCTTGGCTT TCCTGCTGAGTCTCCGA | 2543 |
| HLA-DPB1.1 | 73 | TCCATGATGGTTCTGCAGGTTTCTGCGGCCCCCCGGACAGTGGCTCTGACGGCGTTACTGA TGGTGCTGCTCA | 2544 |
| HLA-DQB1.1 | 67 | GGTCTGCTCGGTGACAGATTTCTATCCAGGCCAGATCAAAGTCCGGTGGTTTCGGAATGAT CAGGAG | 2545 |
| HLADQA1.2 | 76 | CATCTTTCCTCCTGTGGTCAACATCACATGGCTGAGCAATGGGCAGTCAGTCACAGAAGGT GTTTCTGAGACCAGC | 2546 |
| HMGB1.1 | 71 | TGGCCTGTCCATTGGTGATGTTGCGAAGAAACTGGGAGAGATGTGGAATAACACTGCTGCA GATGACAAGC | 2547 |

TABLE B-continued

| Gene | Target Sequence Length | Amplicon Sequence | SEQ ID NO. |
|---|---|---|---|
| HNRPAB.1 | 84 | AGCAGGAGCGACCAACTGATCGCACACATGCTTTGTTTGGATATGGAGTGAACACAATTAT GTACCAAATTTAACTTGGCAAAC | 2548 |
| HPCAL1.1 | 70 | CAGGCAGATGGACACCAACAATGACGGCAAACTGTCCTTGGAAGAATTCATCAGAGGTGCC AAGAGCGAC | 2549 |
| HPD.1 | 78 | AGCTGAAGACGGCCAAGATCAAGGTGAAGGAGAACATTGATGCCCTGGAGGAGCTGAAAAT CCTGGTGGACTACGACG | 2550 |
| HSD11B2.1 | 69 | CCAACCTGCCTCAAGAGCTGCTGCAGGCCTACGGCAAGGACTACATCGAGCACTTGCATGG GCAGTTCC | 2551 |
| HSP90AB1.1 | 66 | GCATTGTGACCAGCACCTACGGCTGGACAGCCAATATGGAGCGGATCATGAAAGCCCAGGC ACTTC | 2552 |
| HSPA1A.1 | 70 | CTGCTGCGACAGTCCACTACCTTTTTCGAGAGTGACTCCCGTTGTCCCAAGGCTTCCCAGA GCGAACCTG | 2553 |
| HSPA8.1 | 73 | CCTCCCTCTGGTGGTGCTTCCTCAGGGCCCACCATTGAAGAGGTTGATTAAGCCAACCAAG TGTAGATGTAGC | 2554 |
| HSPB1.1 | 84 | CCGACTGGAGGAGCATAAAAGCGCAGCCGAGCCCAGCGCCCCGCACTTTTCTGAGCAGACG TCCAGAGCAGAGTCAGCCAGCAT | 2555 |
| HSPG2.1 | 66 | GAGTACGTGTGCCGAGTGTTGGGCAGCTCCGTGCCTCTAGAGGCCTCTGTCCTGGTCACCA TTGAG | 2556 |
| HTATIP.1 | 66 | TCGAATTGTTTGGGCACTGATGAGGACTCCCAGGACAGCTCTGATGGAATACCGTCAGCAC CACGC | 2557 |
| HYAL1.1 | 78 | TGGCTGTGGAGTTCAAATGTCGATGCTACCCTGGCTGGCAGGCACCGTGGTGTGAGCGGAA GAGCATGTGGTGATTGG | 2558 |
| HYAL2.1 | 67 | CAACCATGCACTCCCAGTCTACGTCTTCACACGACCCACCTACAGCCGCAGGCTCACGGGG CTTAGT | 2559 |
| HYAL3.1 | 67 | TATGTCCGCCTCACACACCGGAGATCTGGGAGGTTCCTGTCCCAGGATGACCTTGTGCAGT CCATTG | 2560 |
| ICAM1.1 | 68 | GCAGACAGTGACCATCTACAGCTTTCCGGCGCCCAACGTGATTCTGACGAAGCCAGAGGTC TCAGAAG | 2561 |
| ICAM2.1 | 62 | GGTCATCCTGACACTGCAACCCACTTTGGTGGCTGTGGGCAAGTCCTTCACCATTGAGTGC A | 2562 |
| ICAM3.1 | 67 | GCCTTCAATCTCAGCAACGTGACTGGCAACAGTCGGATCCTCTGCTCAGTGTACTGCAATG GCTCTC | 2563 |
| ID1.1 | 70 | AGAACCGCAAGGTGAGCAAGGTGGAGATTCTCCAGCACGTCATCGACTACATCAGGGACCT TCAGTTGGA | 2564 |
| ID2.4 | 76 | AACGACTGCTACTCCAAGCTCAAGGAGCTGGTGCCCAGCATCCCCCAGAACAAGAAGGTGA GCAAGATGGAAATCC | 2565 |
| ID3.1 | 80 | CTTCACCAAATCCCTTCCTGGAGACTAAACCTGGTGCTCAGGAGCGAAGGACTGTGAACTT GTGGCCTGAAGAGCCAGAG | 2566 |
| IFI27.1 | 71 | CTCTCCGGATTGACCAAGTTCATCCTGGGCTCCATTGGGTCTGCCATTGCGGCTGTCATTG CGAGGTTCTA | 2567 |
| IGF1.2 | 76 | TCCGGAGCTGTGATCTAAGGAGGCTGGAGATGTATTGCGCACCCCTCAAGCCTGCCAAGTC AGCTCGCTCTGTCCG | 2568 |
| IGF1R.3 | 83 | GCATGGTAGCCGAAGATTTCACAGTCAAAATCGGAGATTTTGGTATGACGCGAGATATCTA TGAGACAGACTATTACCGGAAA | 2569 |
| IGF2.2 | 72 | CCGTGCTTCCGGACAACTTCCCCAGATACCCCGTGGGCAAGTTCTTCCAATATGACACCTG GAAGCAGTCCA | 2570 |
| IGFBP2.1 | 73 | GTGGACAGCACCATGAACATGTTGGGCGGGGGAGGCAGTGCTGGCCGGAAGCCCCTCAAGT CGGGTATGAAGG | 2571 |
| IGFBP3.1 | 66 | ACATCCCAACGCATGCTCCTGGAGCTCACAGCCTTCTGTGGTGTCATTTCTGAAACAAGGG CGTGG | 2572 |

TABLE B-continued

| Gene | Target Sequence Length | Amplicon Sequence | SEQ ID NO. |
|---|---|---|---|
| IGFBP5.1 | 69 | TGGACAAGTACGGGATGAAGCTGCCAGGCATGGAGTACGTTGACGGGGACTTTCAGTGCCA CACCTTCG | 2573 |
| IGFBP6.1 | 77 | TGAACCGCAGAGACCAACAGAGGAATCCAGGCACCTCTACCACGCCCTCCCAGCCCAATTC TGCGGGTGTCCAAGAC | 2574 |
| IL-7.1 | 71 | GCGGTGATTCGGAAATTCGCGAATTCCTCTGGTCCTCATCCAGGTGCGCGGGAAGCAGGTG CCCAGGAGAG | 2575 |
| IL-8.1 | 70 | AAGGAACCATCTCACTGTGTGTAAACATGACTTCCAAGCTGGCCGTGGCTCTCTTGGCAGC CTTCCTGAT | 2576 |
| IL10.3 | 79 | GGCGCTGTCATCGATTTCTTCCCTGTGAAAACAAGAGCAAGGCCGTGGAGCAGGTGAAGAA TGCCTTTAATAAGCTCCA | 2577 |
| IL11.2 | 66 | TGGAAGGTTCCACAAGTCACCCTGTGATCAACAGTACCCGTATGGGACAAAGCTGCAAGGT CAAGA | 2578 |
| IL15.1 | 79 | GGCTGGGTACCAATGCTGCAGGTCAACAGCTATGCTGGTAGGCTCCTGCCAGTGTGGAACC ACTGACTACTGGCTCTCA | 2579 |
| IL1B.1 | 67 | AGCTGAGGAAGATGCTGGTTCCCTGCCCACAGACCTTCCAGGAGAATGACCTGAGCACCTT CTTTCC | 2580 |
| IL6.3 | 72 | CCTGAACCTTCCAAAGATGGCTGAAAAAGATGGATGCTTCCAATCTGGATTCAATGAGGAG ACTTGCCTGGT | 2581 |
| IL6ST.3 | 74 | GGCCTAATGTTCCAGATCCTTCAAAGAGTCATATTGCCCAGTGGTCACCTCACACTCCTCC AAGGCACAATTTT | 2582 |
| ILT-2.2 | 63 | AGCCATCACTCTCAGTGCAGCCAGGTCCTATCGTGGCCCCTGAGGAGACCCTGACTCTGCA GT | 2583 |
| IMP3.1 | 72 | GTGGACTCGTCCAAGATCAAGCGGCACGTGCTAGAGTACAATGAGGAGCGCGATGACTTCG ATCTGGAAGCC | 2584 |
| INDO.1 | 66 | CGCCTTGCACGTCTAGTTCTGGGATGCATCACCATGGCATATGTGTGGGCAAAGGTCATG GAGAT | 2585 |
| INHBA.1 | 72 | GTGCCCGAGCCATATAGCAGGCACGTCCGGGTCCTCACTGTCCTTCCACTCAACAGTCATC AACCACTACCG | 2586 |
| INHBB.1 | 72 | AGCCTCCAGGATACCAGCAAATGGATGCGGTGACAAATGGCAGCTTAGCTACAAATGCCTG TCAGTCGGAGA | 2587 |
| INSR.1 | 67 | CAGTCTCCGAGAGCGGATTGAGTTCCTCAATGAGGCCTCGGTCATGAAGGGCTTCACCTGC CATCAC | 2588 |
| IQGAP2.1 | 66 | AGAGACACCAGCAACTGCGCAACAGGAGGTAGACCATGCCACGGACATGGTGAGCCGTGCA ATGAT | 2589 |
| ITGA3.2 | 77 | GTGTCAGACTGAAGCCCCATCCAGCCCGTTCCGCAGGGACTAGAGGCTTTCGGCTTTTTGG GACAGCAAC | 2590 |
| ITGA3.2 | 77 | CCATGATCCTCACTCTGCTGGTGGACTATACACTCCAGACCTCGCTTAGCATGGTAAATCA CCGGCTACAAAGCTTC | 2591 |
| ITGA4.2 | 66 | CAACGCTTCAGTGATCAATCCCGGGGCGATTTACAGATGCAGGATCGGAAAGAATCCCGGC CAGAC | 2592 |
| ITGA5.1 | 75 | AGGCCAGCCCTACATTATCAGAGCAAGAGCCGGATAGAGGACAAGGCTCAGATCTTGCTGG ACTGTGGAGAAGAC | 2593 |
| ITGA6.2 | 69 | CAGTGACAAACAGCCCTTCCAACCCAAGGAATCCCACAAAAGATGGCGATGACGCCCATGA GGCTAAAC | 2594 |
| ITGA7.1 | 79 | GATATGATTGGTCGCTGCTTTGTGCTCAGCCAGGACCTGGCCATCCGGGATGAGTTGGATG GTGGGAATGGAAGTTCT | 2595 |
| ITGAV.1 | 79 | ACTCGGACTGCACAAGCTATTTTTGATGACAGCTATTTGGGTTATTCTGTGGCTGTCGGAG ATTTCAATGGTGATGGCA | 2596 |
| ITGB1.1 | 74 | TCAGAATTGGATTTGGCTCATTTGTGGAAAAGACTGTGATGCCTTACATTAGCACAACACC AGCTAAGCTCAGG | 2597 |

TABLE B-continued

| Gene | Target Sequence Length | Amplicon Sequence | SEQ ID NO. |
|---|---|---|---|
| ITGB3.1 | 78 | ACCGGGGAGCCCTACATGACGAAAATACCTGCAACCGTTACTGCCGTGACGAGATTGAGTCAGTGAAAGAGCTTAAGG | 2598 |
| ITGB4.2 | 66 | CAAGGTGCCCTCAGTGGAGCTCACCAACCTGTACCCGTATTGCGACTATGAGATGAAGGTGTGCGC | 2599 |
| ITGB5.1 | 71 | TCGTGAAAGATGACCAGGAGGCTGTGCTATGTTTCTACAAAACCGCCAAGGACTGCGTCATGATGTTCACC | 2600 |
| JAG1.1 | 69 | TGGCTTACACTGGCAATGGTAGTTTCTGTGGTTGGCTGGGAAATCGAGTGCCGCATCTCACAGCTATGC | 2601 |
| K-ras.10 | 71 | GTCAAAATGGGGAGGGACTAGGGCAGTTTGGATAGCTCAACAAGATACAATCTCACTCTGTGGTGGTCCTG | 2602 |
| KCNJ15.1 | 67 | GGACGTTCTACCTGCCTTGAAGAAGACACCTGACCTGCGGAGTGAGTGACCAGTGTTTCCAGAGCCT | 2603 |
| KDR.6 | 68 | GAGGACGAAGGCCTCTACACCTGCCAGGCATGCAGTGTTCTTGGCTGTGCAAAAGTGGAGGCATTTTT | 2604 |
| Ki-67.2 | 80 | CGGACTTTGGGTGCGACTTGACGAGCGGTGGTTCGACAAGTGGCCTTGCGGGCCGGATCGTCCCAGTGGAAGAGTTGTAA | 2605 |
| KIAA1303 raptor.1 | 66 | ACTACAGCGGGAGCAGGAGCTGGAGGTAGCTGCAATCAACCCAAATCACCCTCTTGCTCAGATGCC | 2606 |
| KIF1A.1 | 66 | CTCCTACTGGTCGCACACCTCACCTGAGGACATCAACTACGCGTCGCAGAAGCAGGTGTACCGGGA | 2607 |
| Kiting.4 | 79 | GTCCCCGGGATGGATGTTTTGCCAAGTCATTGTTGGATAAGCGAGATGGTAGTACAATTGTCAGACAGCTTGACTGATC | 2608 |
| KL.1 | 72 | GAGGTCCTGTCTAAACCCTGTGTCCCTGAGGGATCTGTCTCACTGGCATCTTGTTGAGGGCCTTGCACATAG | 2609 |
| KLK3.1 | 66 | CCAAGCTTACCACCTGCACCCGGAGAGCTGTGTCACCATGTGGGTCCCGGTTGTCTTCCTCACCCT | 2610 |
| KLRK1.2 | 70 | TGAGAGCCAGGCTTCTTGTATGTCTCAAAATGCCAGCCTTCTGAAAGTATACAGCAAAGAGGACCAGGAT | 2611 |
| KRT19.3 | 77 | TGAGCGGCAGAATCAGGAGTACCAGCGGCTCATGGACATCAAGTCGCGGCTGGAGCAGGAGATTGCCACCTACCGCA | 2612 |
| KRT5.3 | 69 | TCAGTGGAGAAGGAGTTGGACCAGTCAACATCTCTGTTGTCACAAGCAGTGTTTCCTCTGGATATGGCA | 2613 |
| KRT7.1 | 71 | TTCAGAGATGAACCGGGCCATCCAGAGGCTGCAGGCTGAGATCGACAACATCAAGAACCAGCGTGCCAAGT | 2614 |
| L1CAM.1 | 66 | CTTGCTGGCCAATGCCTACATCTACGTTGTCCAGCTGCCAGCCAAGATCCTGACTGCGGACAATCA | 2615 |
| LAMA3.1 | 73 | CAGATGAGGCACATGGAGACCCAGGCCAAGGACCTGAGGAATCAGTTGCTCAACTACCGTTCTGCCATTTCAA | 2616 |
| LAMA4.1 | 67 | GATGCACTGCGGTTAGCAGCGCTCTCCATCGAGGAAGGCAAATCCGGGGTGCTGAGCGTATCCTCTG | 2617 |
| LAMB1.1 | 66 | CAAGGAGACTGGGAGGTGTCTCAAGTGCCTGTACCACACGGAAGGGGAACACTGTCAGTTCTGCCG | 2618 |
| LAMB3.1 | 67 | ACTGACCAAGCCTGAGACCTACTGCACCCAGTATGGCGAGTGGCAGATGAAATGCTGCAAGTGTGAC | 2619 |
| LAMC2.2 | 80 | ACTCAAGCGGAAATTGAAGCAGATAGGTCTTATCAGCACAGTCTCCGCCTCCTGGATTCAGTGTCTCGGCTTCAGGGAGT | 2620 |
| LAPTM5.1 | 66 | TGCTGGACTTCTGCCTGAGCATCCTGACCCTCTGCAGCTCCTACATGGAAGTGCCCACCTATCTCA | 2621 |
| LDB1.2 | 67 | AACACCCAGTTTGACGCAGCCAACGGCATTGACGACGAGGACAGCTTTAACAACTCCCCTGCACTGG | 2622 |

TABLE B-continued

| Gene | Target Sequence Length | Amplicon Sequence | SEQ ID NO. |
|---|---|---|---|
| LDB2.1 | 66 | ATCACGGTGGACTGCGACCAGTGTACCATGGTCACCCAGCACGGGAAGCCCATGTTTACCAAGGTA | 2623 |
| LDHA.2 | 74 | AGGCTACACATCCTGGGCTATTGGACTCTCTGTAGCAGATTTGGCAGAGAGTATAATGAAGAATCTTAGGCGGG | 2624 |
| LGALS1.1 | 72 | GGGTGGAGTCTTCTGACAGCTGGTGCGCCTGCCCGGGAACATCCTCCTGGACTCAATCATGGCTTGTGGTCT | 2625 |
| LGALS3.1 | 69 | AGCGGAAAATGGCAGACAATTTTTCGCTCCATGATGCGTTATCTGGGTCTGGAAACCCAAACCCTCAAG | 2626 |
| LGALS9.1 | 67 | AGTACTTCCACCGCGTGCCCTTCCACCGTGTGGACACCATCTCCGTCAATGGCTCTGTGCAGCTGTC | 2627 |
| LIMK1.1 | 67 | GCTTCAGGTGTTGTGACTGCAGTGCCTCCCTGTCGCACCAGTACATATGAGAAGGATGGGCAGCTCTT | 2628 |
| LMNB1.1 | 66 | TGCAAACGCTGGTGTCACAGCCAGCCCCCCAACTGACCTCATCTGGAAGAACCAGAACTCGTGGGG | 2629 |
| LMO2.1 | 74 | GGCTGCCAGCAGAACATCGGGGACCGCTACTTCCTGAAGGCCATCGACCAGTACTGGCACGAGGACTGCCTGAG | 2630 |
| LOX.1 | 66 | CCAATGGGAGAACAACGGGCAGGTGTTCAGCTTGCTGAGCCTGGGCTCACAGTACCAGCCTCAGCG | 2631 |
| LRP2.1 | 66 | GGCTGTAGACTGGGTTTCCAGAAAGCTCTACTGGTTGGATGCCCGCCTGGATGGCCTCTTTGTCTC | 2632 |
| LRRC2.1 | 71 | CCAGTGTCCCAATCTGTGTCCTGCGGATGTCGAATTTGCAGTGGTTGGATATCAGCAGCAATAACCTGACC | 2633 |
| LTF.1 | 68 | AACGGAAGCCTGTGACTGAGGCTAGAAGCTGCCATCTTGCCATGGCCCCGAATCATGCCGTGGTGTCT | 2634 |
| LYZ.1 | 80 | TTGCTGCAAGATAACATCGCTGATGCTGTAGCTTGTGCAAAGAGGGTTGTCCGTGATCCACAAGGCATTAGAGCATGGGT | 2635 |
| MADH2.1 | 70 | GCTGCCTTTGGTAAGAACATGTCGTCCATCTTGCCATTCACGCCGCCAGTTGTGAAGAGACTGCTGGGAT | 2636 |
| MADH4.1 | 76 | GGACATTACTGGCCTGTTCACAATGAGCTTGCATTCCAGCCTCCCATTTCCAATCATCCTGCTCCTGAGTATTGGT | 2637 |
| MAL.1 | 66 | GTTGGGAGCTTGCTGTGTCTAACCTCCAACTGCTGTGCTGTCTGCTAGGGTCACCTCCTGTTTGTG | 2638 |
| MAL2.1 | 67 | CCTTCGTCTGCCTGGAGATTCTGTTCGGGGGTCTTGTCTGGATTTTGGTTGCCTCCTCCAATGTTCC | 2639 |
| MAP2K1.1 | 76 | GCCTTTCTTACCCAGAAGCAGAAGGTGGGAGAACTGAAGGATGACGACTTTGAGAAGATCAGTGAGCTGGGGCTG | 2640 |
| MAP2K3.1 | 67 | GCCCTCCAATGTCCTTATCAACAAGGAGGGCCATGTGAAGATGTGTGACTTTGGCATCAGTGGCTAC | 2641 |
| MAP4.1 | 72 | GCCGGTCAGGCACACAAGGGGCCCTTGGAGCGTGGACTGGTTGGTTTTGCCATTTTGTTGTGTGTATGCTGC | 2642 |
| MARCKS.1 | 67 | CCCCTCTTGGATCTGTTGAGTTTCTTTGTTGAAGAAGCCAGCATGGGTGCCCAGTTCTCCAAGACCG | 2643 |
| Maspin.2 | 77 | CAGATGGCCACTTTGAGAACATTTTAGCTGACAACAGTGTGAACGACCAGACCAAAATCCTTGTGGTTAATGCTGCC | 2644 |
| MCAM.1 | 66 | CGAGTTCCAGTGGCTGAGAGAAGAGACAGGCCAGGTGCTGGAAAGGGGGCCTGTGCTTCAGTTGCA | 2645 |
| MCM2.2 | 75 | GACTTTTGCCCGCTACCTTTCATTCCGGCGTGACAACAATGAGCTGTTGCTCTTCATACTGAAGCAGTTAGTGGC | 2646 |
| MCM3.3 | 75 | GGAGAACAATCCCCTTGAGACAGAATATGGCCTTTCTGTCTACAAGGATCACCAGACCATCACCATCCAGGAGAT | 2647 |

TABLE B-continued

| Gene | Target Sequence Length | Amplicon Sequence | SEQ ID NO. |
|---|---|---|---|
| MCM6.3 | 82 | TGATGGTCCTATGTGTCACATTCATCACAGGTTTCATACCAACACAGGCTTCAGCACTTCCTTTGGTGTGTTTCCTGTCCCA | 2648 |
| MCP1.1 | 71 | CGCTCAGCCAGATGCAATCAATGCCCCAGTCACCTGCTGTTATAACTTCACCAATAGGAAGATCTCAGTGC | 2649 |
| MDH2.1 | 63 | CCAACACCTTTGTTGCAGAGCTGAAGGGTTTGGATCCAGCTCGAGTCAACGTCCCTGTCATTG | 2650 |
| MDK.1 | 66 | GGAGCCGACTGCAAGTACAAGTTTGAGAACTGGGGTGCGTGTGATGGGGGCACAGGCACCAAAGTC | 2651 |
| MDM2.1 | 68 | CTACAGGGACGCCATCGAATCCGGATCTTGATGCTGGTGTAAGTGAACATTCAGGTGATTGGTTGGAT | 2652 |
| MGMT.1 | 69 | GTGAAATGAAACGCACCACACTGGACAGCCCTTTGGGGAAGCTGGAGCTGTCTGGTTGTGAGCAGGGTC | 2653 |
| mGST1.2 | 79 | ACGGATCTACCACACCATTGCATATTTGACACCCCTTCCCCAGCCAAATAGAGCTTTGAGTTTTTTTGTTGGATATGGA | 2654 |
| MICA.1 | 68 | ATGGTGAATGTCACCCGCAGCGAGGCCTCAGAGGGCAACATTACCGTGACATGCAGGGCTTCTGGCTT | 2655 |
| MIF.2 | 66 | CCGGACAGGGTCTACATCAACTATTACGACATGAACGCGGCCAATGTGGGCTGGAACAACTCCACC | 2656 |
| MMP1.1 | 72 | GGGAGATCATCGGGACAACTCTCCTTTTGATGGACCTGGAGGAAATCTTGCTCATGCTTTTCAACCAGGCCC | 2657 |
| MMP10.1 | 66 | TGGAGGTGACAGGGAAGCTAGACACTGACACTCTGGAGGTGATGCGCAAGCCCAGGTGTGGAGTTC | 2658 |
| MMP14.1 | 66 | GCTGTGGAGCTCTCAGGAAGGGCCCTGAGGAAGGCACACTTGCTCCTGTTGGTCCCTGTCCTTGCT | 2659 |
| MMP2.2 | 86 | CCATGATGGAGAGGCAGACATCATGATCAACTTTGGCCGCTGGGAGCATGGCGATGGATACCCCTTTGACGGTAAGGACGGACTCC | 2660 |
| MMP7.1 | 79 | GGATGGTAGCAGTCTAGGGATTAACTTCCTGTATGCTGCAACTCATGAACTTGGCCATTCTTTGGGTATGGGACATTCC | 2661 |
| MMP9.1 | 67 | GAGAACCAATCTCACCGACAGGCAGCTGGCAGAGGAATACCTGTACCGCTATGGTTACACTCGGGTG | 2662 |
| MRP1.1 | 79 | TCATGGTGCCCGTCAATGCTGTGATGGCGATGAAGACCAAGACGTATCAGGTGGCCCACATGAAGAGCAAAGACAATCG | 2663 |
| MRP2.3 | 65 | AGGGGATGACTTGGACACATCTGCCATTCGACATGACTGCAATTTTGACAAAGCCATGCAGTTTT | 2664 |
| MRP3.1 | 91 | TCATCCTGGCGATCTACTTCCTCTGGCAGAACCTAGGTCCCTCTGTCCTGGCTGGAGTCGCTTTCATGGTCTTGCTGATTCCACTCAACGG | 2665 |
| MRP4.2 | 66 | AGCGCCTGGAATCTACAACTCGGAGTCCAGTGTTTTCCCACTTGTCATCTTCTCTCCAGGGGCTCT | 2666 |
| MSH2.3 | 73 | GATGCAGAATTGAGGCAGACTTTACAAGAAGATTTACTTCGTCGATTCCCAGATCTTAACCGACTTGCCAAGA | 2667 |
| MSH3.2 | 82 | TGATTACCATCATGGCTCAGATTGGCTCCTATGTTCCTGCAGAAGAAGCGACAATTGGGATTGTGGATGGCATTTTCACAAG | 2668 |
| MSH6.3 | 68 | TCTATTGGGGATTGGTAGGAACCGTTACCAGCTGGAAATTCCTGAGAATTTCACCACTCGCAATTTG | 2669 |
| MT1B.1 | 66 | GTGGGCTGTGCCAAGTGTGCCCAGGGCTGTGTCTGCAAAGGCTCATCAGAGAAGTGCCGCTGCTGT | 2670 |
| MT1G.1 | 74 | GTGCACCCACTGCCTCTTCCCTTCTCGCTTGGGAACTCTAGTCTCGCCTCGGGTTGCAATGGACCCCAACTGCT | 2671 |
| MT1H.1 | 74 | CGTGTTCCACTGCCTCTTCTCTTCTCGCTTGGGAACTCCAGTCTCACCTCGGCTTGCAATGGACCCCAACTGCT | 2672 |

TABLE B-continued

| Gene | Target Sequence Length | Amplicon Sequence | SEQ ID NO. |
|---|---|---|---|
| MT1X.1 | 80 | CTCCTGCAAATGCAAAGAGTGCAAATGCACCTCCTGCAAGAAGAGCTGCTGCTCCTGCTGC CCTGTGGGCTGTGCCAAGT | 2673 |
| MUC1.2 | 71 | GGCCAGGATCTGTGGTGGTACAATTGACTCTGGCCTTCCGAGAAGGTACCATCAATGTCCA CGACGTGGAG | 2674 |
| MVP.1 | 75 | ACGAGAACGAGGGCATCTATGTGCAGGATGTCAAGACCGGAAAGGTGCGCGCTGTGATTGG AAGCACCTACATGC | 2675 |
| MX1.1 | 78 | GAAGGAATGGGAATCAGTCATGAGCTAATCACCCTGGAGATCAGCTCCCGAGATGTCCCGG ATCTGACTCTAATAGAC | 2676 |
| MYBL2.1 | 74 | GCCGAGATCGCCAAGATGTTGCCAGGGAGGACAGACAATGCTGTGAAGAATCACTGGAACT CTACCATCAAAAG | 2677 |
| MYH11.1 | 85 | CGGTACTTCTCAGGGCTAATATATACGTACTCTGGCCTCTTCTGCGTGGTGGTCAACCCCT ATAAACACCTGCCCATCTACTCGG | 2678 |
| MYRIP.2 | 69 | CCTTCACCTTCCTCGTCAACACCAAGCGCCAGTGTGGAGATTGCAAATTCAATGTCTGCAA GAGCTGCT | 2679 |
| NBN.1 | 76 | GCATCTACTTGCCAGAACCAAATTAACTTACTTCCAAGTTCTGGCTGCTTGCAGGTGGAAC TCCAGCTGCAAGGGA | 2680 |
| NCF1.1 | 66 | GACACCTTCATCCGTCACATCGCCCTGCTGGGCTTTGAGAAGCGCTTCGTACCCAGCCAGC ACTAT | 2681 |
| NFAT5.1 | 70 | CTGAACCCCTCTCCTGGTCACCGAGAATCAGTCCCCGTGGAGTTCCCCCTCCACCTCGCCA TCGTTTCCT | 2682 |
| NFATC2.1 | 72 | CAGTCAAGGTCAGAGGCTGAGCCCGGGTTCCTACCCCACAGTCATTCAGCAGCAGAATGCC ACGAGCCAAAG | 2683 |
| NFKBp50.3 | 73 | CAGACCAAGGAGATGGACCTCAGCGTGGTGCGGCTCATGTTTACAGCTTTTCTTCCGGATA GCACTGGCAGCT | 2684 |
| NFKBp65.3 | 68 | CTGCCGGGATGGCTTCTATGAGGCTGAGCTCTGCCCGGACCGCTGCATCCACAGTTTCCAG AACCTGG | 2685 |
| NFX1.1 | 74 | CCCTGCCATACCAGCTCACCCTGCCCTGTGACTGCTTGTAAAGCTAAGGTAGAGCTACAGT GTGAATGTGGACG | 2686 |
| NME2.1 | 66 | ATGCTTGGGGAGACCAATCCAGCAGATTCAAAGCCAGGCACCATTCGTGGGGACTTCTGCA TTCAG | 2687 |
| NNMT.1 | 67 | CCTAGGGCAGGGATGGAGAGAGAGTCTGGGCATGAGGAGAGGGTCTCGGGATGTTTGGCTG GACTAG | 2688 |
| NOL3.1 | 72 | CAGCCTTGGGAAGTGAGACTAGAAGAGGGGAGCAGAAAGGGACCTTGAGTAGACAAAGGCC ACACACATCAT | 2689 |
| NOS2A.3 | 67 | GGGTCCATTATGACTCCCAAAAGTTTGACCAGAGGACCCAGGGACAAGCCTACCCCTCCAG ATGAGC | 2690 |
| NOS3.1 | 68 | ATCTCCGCCTCGCTCATGGGCACGGTGATGGCGAAGCGAGTGAAGGCGACAATCCTGTATG CCTCCGA | 2691 |
| NOTCH1.1 | 76 | CGGGTCCACCAGTTTGAATGGTCAATGCGAGTGGCTGTCCCGGCTGCAGAGCGGCATGGTG CCGAACCAATACAAC | 2692 |
| NOTCH2.1 | 75 | CACTTCCCTGCTGGGATTATATCAACAACCAGTGTGATGAGCTGTGCAACACGGTCGAGTG CCTGTTTGACAACT | 2693 |
| NOTCH3.1 | 67 | TGTGGACGAGTGTGCTGGCCCCGCACCCTGTGGCCCTCATGGTATCTGCACCAACCTGGCA GGGAGT | 2694 |
| NPD009 (ABAT offici | 73 | GGCTGTGGCTGAGGCTGTAGCATCTCTGCTGGAGGTGAGACACTCTGGGAACTGATTTGAC CTCGAATGCTCC | 2695 |
| NPM1.2 | 84 | AATGTTGTCCAGGTTCTATTGCCAAGAATGTGTTGTCCAAAATGCCTGTTTAGTTTTTAAA GATGGAACTCCACCCTTTGCTTG | 2696 |
| NPPB.1 | 66 | GACACCTGCTTCTGATTCCACAAGGGGCTTTTTCCTCAACCCTGTGGCCGCTTTGAAGTGA CTCA | 2697 |

TABLE B-continued

| Gene | Target Sequence Length | Amplicon Sequence | SEQ ID NO. |
|---|---|---|---|
| NPR1.1 | 66 | ACATCTGCAGCTCCCCTGATGCCTTCAGAACCCTCATGCTCCTGGCCCTGGAAGCTGGCTT GTGTG | 2698 |
| NPY1R.1 | 70 | GGATCTTCCCCACTCTGCTCCCTTCCATTCCCACCCTTCCTTCTTTAATAAGCAGGAGCGA AAAAGACAA | 2699 |
| NRG1.3 | 83 | CGAGACTCTCCTCATAGTGAAAGGTATGTGTCAGCCATGACCACCCCGGCTCGTATGTCAC CTGTAGATTTCCACACGCCAAG | 2700 |
| NUDT1.1 | 77 | ACTGGTTTCCACTCCTGCTTCAGAAGAAGAAATTCCACGGGTACTTCAAGTTCCAGGGTCA GGACACCATCCTGGAC | 2701 |
| OGG1.1 | 71 | ACCAAGGTGGCTGACTGCATCTGCCTGATGGCCCTAGACAAGCCCCAGGCTGTGCCCGTGG ATGTCCATAT | 2702 |
| OPN, osteopontin.3 | 80 | CAACCGAAGTTTTCACTCCAGTTGTCCCCACAGTAGACACATATGATGGCCGAGGTGATAG TGTGGTTTATGGACTGAGG | 2703 |
| p21.3 | 65 | TGGAGACTCTCAGGGTCGAAAACGGCGGCAGACCAGCATGACAGATTTCTACCACTCCAAA CGCC | 2704 |
| p27.3 | 66 | CGGTGGACCACGAAGAGTTAACCCGGGACTTGGAGAAGCACTGCAGAGACATGGAAGAGGC GAGCC | 2705 |
| P53.2 | 68 | CTTTGAACCCTTGCTTGCAATAGGTGTGCGTCAGAAGCACCCAGGACTTCCATTTGCTTTG TCCCGGG | 2706 |
| PAH.1 | 80 | TGGCTGATTCCATTAACAGTGAAATTGGAATCCTTTGCAGTGCCCTCCAGAAAATAAAGTA AAGCCATGGACAGAATGTG | 2707 |
| PAI1.3 | 81 | CCGCAACGTGGTTTTCTCACCCTATGGGGTGGCCTCGGTGTTGGCCATGCTCCAGCTGACA ACAGGAGGAGAAACCCAGCA | 2708 |
| Pak1.2 | 70 | GAGCTGTGGGTTGTTATGGAATACTTGGCTGGAGGCTCCTTGACAGATGTGGTGACAGAAA CTTGCATGG | 2709 |
| PARD6A.1 | 66 | GATCCTCGAGGTCAATGGCATTGAAGTAGCCGGGAAGACCTTGGACCAAGTGACGGACATG ATGGT | 2710 |
| PBOV1.1 | 72 | GCAAAGCCTTTCCAGAAAAATAAAAATGGTTGAAAAGGCAATTCTGCTACCAATGACTGTT TAAGCCCAGCC | 2711 |
| PCCA.1 | 68 | GGTGAAATCTGTGCACTGTCAAGCTGGAGACACAGTTGGAGAAGGGGATCTGCTCGTGGAG CTGGAAT | 2712 |
| PCK1.1 | 66 | CTTAGCATGGCCCAGCACCCAGCAGCCAAACTGCCCAAGATCTTCCATGTCAACTGGTTCC GGAAG | 2713 |
| PCNA.2 | 71 | GAAGGTGTTGGAGGCACTCAAGGACCTCATCAACGAGGCCTGCTGGGATATTAGCTCCAGC GGTGTAAACC | 2714 |
| PCSK6.1 | 67 | ACCTTGAGTAGCAGAGGCCCTCACACCTTCCTCAGAATGGACCCCCAGGTGAAATGGCTCC AGCAAC | 2715 |
| PDCD1.1 | 73 | GACAACGCCACCTTCACCTGCAGCTTCTCCAACACATCGGAGAGCTTCGTGCTAAACTGGT ACCGCATGAGCC | 2716 |
| PDE4DIP.1 | 73 | GCTTCGTCTTGCTGTGAGAGAGCGAGATCATGACTTAGAGAGACTGCGCGATGTCCTCTCC TCCAATGAAGCT | 2717 |
| PDGFA.3 | 67 | TTGTTGGTGTGCCCTGGTGCCGTGGTGGCGGTCACTCCCTCTGCTGCCAGTGTTTGGACAG AACCCA | 2718 |
| PDGFB.3 | 62 | ACTGAAGGAGACCCTTGGAGCCTAGGGGCATCGGCAGGAGAGTGTGTGGGCAGGGTTATTT A | 2719 |
| PDGFC.3 | 79 | AGTTACTAAAAAATACCACGAGGTCCTTCAGTTGAGACCAAAGACCGGTGTCAGGGGATTG CACAAATCACTCACCGAC | 2720 |
| PDGFD.2 | 74 | TATCGAGGCAGGTCATACCATGACCGGAAGTCAAAAGTTGACCTGGATAGGCTCAATGATG ATGCCAAGCGTTA | 2721 |
| PDGFRa.2 | 72 | GGGAGTTTCCAAGAGATGGACTAGTGCTTGGTCGGGTCTTGGGGTCTGGAGCGTTTGGGAA GGTGGTTGAAG | 2722 |

TABLE B-continued

| Gene | Target Sequence Length | Amplicon Sequence | SEQ ID NO. |
|---|---|---|---|
| PDGFRb.3 | 66 | CCAGCTCTCCTTCCAGCTACAGATCAATGTCCCTGTCCGAGTGCTGGAGCTAAGTGAGAGCCACCC | 2723 |
| PDZK1.1 | 75 | AATGACCTCCACCTTCAACCCCCGAGAATGTAAACTGTCCAAGCAAGAAGGGCAAAACTATGGCTTCTTCCTGCG | 2724 |
| PDZK3.1 | 68 | GAGCTGAGAGCCTTGAGCATGCCTGACCTTGACAAGCTCTGCAGCGAGGATTACTCAGCAGGGCCGAG | 2725 |
| PF4.1 | 73 | GCAGTGCCTGTGTGTGAAGACCACCTCCCAGGTCCGTCCCAGGCACATCACCAGCCTGGAGGTGATCAAGGCC | 2726 |
| PFKP.1 | 68 | AGCTGATGCCGCATACATTTTCGAAGAGCCCTTCGACATCAGGGATCTGCAGTCCAACGTGGAGCACC | 2727 |
| PFN2.1 | 82 | TCTATACGTCGATGGTGACTGCACAATGGACATCCGGACAAAGAGTCAAGGTGGGGAGCCAACATACAATGTGGCTGTCGGC | 2728 |
| PGF.1 | 71 | GTGGTTTTCCCTCGGAGCCCCCTGGCTCGGGACGTCTGAGAAGATGCCGGTCATGAGGCTGTTCCCTTGCT | 2729 |
| PI3K.2 | 98 | TGCTACCTGGACAGCCCGTTGGTGCGCTTCCTCCTGAAACGAGCTGTGTCTGACTTGAGAGTGACTCACTACTTCTTCTGGTTACTGAAGGACGGCCT | 2730 |
| PI3KC2A.1 | 83 | ATACCAATCACCGCACAAACCCAGGCTATTTGTTAAGTCCAGTCACAGCACAAAGAAACATATGCGGAGAAAATGCTAGTGTG | 2731 |
| PIK3CA.1 | 67 | GTGATTGAAGAGCATGCCAATTGGTCTGTATCCCGAGAAGCAGGATTTAGCTATTCCCACGCAGGAC | 2732 |
| PLA2G4C.1 | 68 | CCCTTTCCCCAAGTAGAAGAGGCTGAGCTGGATTTGTGGTCCAAGGCCCCCGCCAGCTGCTACATCCT | 2733 |
| PLAT.1 | 67 | GATTTGCTGGGAAGTGCTGTGAAATAGATACCAGGGCCACGTGCTACGAGGACCAGGGCATCAGCTA | 2734 |
| PLAUR.3 | 76 | CCCATGGATGCTCCTCTGAAGAGACTTTCCTCATTGACTGCCGAGGCCCCATGAATCAATGTCTGGTAGCCACCGG | 2735 |
| PLG.1 | 77 | GGCAAAATTTCCAAGACCATGTCTGGACTGGAATGCCAGGCCTGGGACTCTCAGAGCCCACACGCTCATGGATACAT | 2736 |
| PLN.1 | 84 | TGATGCTTCTCTGAAGTTCTGCTACAACCTCTAGATCTGCAGCTTGCCACATCAGCTTAAAATCTGTCATCCCATGCAGACAGG | 2737 |
| PLOD2.1 | 84 | CAGGGAGGTGGTTGCAAATTTCTAAGGTACAATTGCTCTATTGAGTCACCACGAAAAGGCTGGAGCTTCATGCATCCTGGGAGA | 2738 |
| PLP1.1 | 66 | AGAACAGACTGGCCTGAGGAGCAGCAGTTGCTGGTGGCTAATGGTGTAACCTGAGATGGCCCTCTG | 2739 |
| PMP22.1 | 66 | CCATCTACACGGTGAGGCACCCGGAGTGGCATCTCAACTCGGATTACTCCTACGGTTTCGCCTACA | 2740 |
| PPAP2B.1 | 77 | ACAAGCACCATCCCAGTGATGTTCTGGCAGGATTTGCTCAAGGAGCCCTGGTGGCCTGCTGCATAGTTTTCTTCGTG | 2741 |
| PPARG.3 | 72 | TGACTTTATGGAGCCCAAGTTTGAGTTTGCTGTGAAGTTCAATGCACTGGAATTAGATGACAGCGACTTGGC | 2742 |
| PPP1R3C.1 | 82 | TTCCTTCCCTCTCAATCCACTAGCTTTCATGTTGGGCAAGGAAAAGTTGAGGAAGGATGGCTGATGGTGATGGAAAGCTGTG | 2743 |
| PPP2CA.1 | 78 | GCAATCATGGAACTTGACGATACTCTAAAATACTCTTTCTTGCAGTTTGACCCAGCACCTCGTAGAGGCGAGCCACAT | 2744 |
| PRCC.1 | 67 | GAGGAAGAGGAGGCGGTGGCTCCTACATCTGGGCCCGCTTTAGGGGCTTGTTCGCTTCTCTCCCTG | 2745 |
| PRKCA.1 | 70 | CAAGCAATGCGTCATCAATGTCCCCAGCCTCTGCGGAATGGATCACACTGAGAAGAGGGGGCGGATTTAC | 2746 |
| PRKCB1.1 | 67 | GACCCAGCTCCACTCCTGCTTCCAGACCATGGACCGCCTGTACTTTGTGATGGAGTACGTGAATGGG | 2747 |

TABLE B-continued

| Gene | Target Sequence Length | Amplicon Sequence | SEQ ID NO. |
|---|---|---|---|
| PRKCD.2 | 68 | CTGACACTTGCCGCAGAGAATCCCTTTCTCACCCACCTCATCTGCACCTTCCAGACCAAGGACCACCT | 2748 |
| PRKCH.1 | 68 | CTCCACCTATGAGCGTCTGTCTCTGTGGGCTTGGGATGTTAACAGGAGCCAAAAGGAGGGAAAGTGTG | 2749 |
| PRO2000.3 | 79 | ATTGGAAAAACCTCGTCACCAGAGAAAGCCCAACATATTTTATAGTGGCCCAGCTTCTCCTGCAAGACCAAGATACCGA | 2750 |
| PROM1.1 | 74 | CTATGACAGGCATGCCACCCCGACCACCCGAGGCTGTGTCTCCAACACCGGAGGCGTCTTCCTCATGGTTGGAG | 2751 |
| PROM2.1 | 67 | CTTCAGCGCATCCACTACCCCGACTTCCTCGTTCAGATCCAGAGGCCCGTGGTGAAGACCAGCATGG | 2752 |
| PRPS2.1 | 69 | CACTGCACCAAGATTCAGGTCATTGACATTTCCATGATCTTGGCCGAAGCAATCCGAAGGACACACAAT | 2753 |
| PRSS8.1 | 68 | GTACACTCTGGCCTCCAGCTATGCCTCCTGGATCCAAAGCAAGGTGACAGAACTCCAGCCTCGTGTGG | 2754 |
| PSMA7.1 | 67 | GCCAAACTGCAGGATGAAAGAACAGTGCGGAAGATCTGTGCTTTGGATGACAACGTCTGCATGGCCT | 2755 |
| PSMB8.1 | 66 | CAGTGGCTATCGGCCTAATCTTAGCCCTGAAGAGGCCTATGACCTTGGCCGCAGGGCTATTGCTTA | 2756 |
| PSMB9.1 | 66 | GGGGTGTCATCTACCTGGTCACTATTACAGCTGCCGGTGTGGACCATCGAGTCATCTTGGGCAATG | 2757 |
| PTEN.2 | 81 | TGGCTAAGTGAAGATGACAATCATGTTGCAGCAATTCACTGTAAAGCTGGAAAGGGACGAACTGGTGTAATGATATGTGCA | 2758 |
| PTGIS.1 | 66 | CCACACTGGCATCTCCCTGACCTTCTCCAGGGACAGAAGCAGGAGTAAGTTTCTCATCCCATGGGC | 2759 |
| PTHR1.1 | 73 | CGAGGTACAAGCTGAGATCAAGAAATCTTGGAGCCGCTGGACACTGGCACTGGACTTCAAGCGAAAGGCACGC | 2760 |
| PTK2.1 | 68 | GACCGGTCGAATGATAAGGTGTACGAGAATGTGACGGGCCTGGTGAAAGCTGTCATCGAGATGTCCAG | 2761 |
| PTK2B.1 | 74 | CAAGCCCAGCCGACCTAAGTACAGACCCCCTCCGCAAACCAACCTCCTGGCTCCAAAGCTGCAGTTCCAGGTTC | 2762 |
| PTN.1 | 67 | CCTTCCAGTCCAAAAATCCCGCCAAGAGAGCCCCAGAGCAGAGGAAAATCCAAAGTGGAGAGAGGGG | 2763 |
| PTPNS1.1 | 77 | CTCCAGCTAGCACTAAGCAACATCTCGCTGTGGACGCCTGTAAATTACTGAGAAATGTGAAACGTGCAATCTTGAAA | 2764 |
| PTPRB.1 | 68 | GATATGCGGTGAGGAACAGCTTGATGCACACAGACTCATCCGCCACTTTCACTATACGGTGTGGCCAG | 2765 |
| PTPRC.1 | 74 | TGGCCGTCAATGGAAGAGGGCACTCGGGCTTTTGGAGATGTTGTTGTAAAGATCAACCAGCACAAAAGATGTCC | 2766 |
| PTPRG.1 | 71 | GGACAGCGACAAAGACTTGAAAGCCACCATTAGCCATGTCTCACCCGATAGCCTTTACCTGTTCCGAGTCC | 2767 |
| PTTG1.2 | 74 | GGCTACTCTGATCTATGTTGATAAGGAAAATGGAGAACCAGGCACCCGTGTGGTTGCTAAGGATGGGCTGAAGC | 2768 |
| PVALB.1 | 81 | AAACCAAGATGCTGATGGCTGCTGGAGACAAAGATGGGGACGGCAAAATTGGGGTTGACGAATTCTCCACTCTGGTGGCTG | 2769 |
| PXDN.1 | 67 | GCTGCTCAAGCTGAACCCGCACTGGGACGGCGACACCATCTACTATGAGACCAGGAAGATCGTGGGT | 2770 |
| RAC1.3 | 66 | TGTTGTAAATGTCTCAGCCCCTCGTTCTTGGTCCTGTCCCTTGGAACCTTTGTACGCTTTGCTCAA | 2771 |
| RAD51.1 | 66 | AGACTACTCGGGTCGAGGTGAGCTTTCAGCCAGGCAGATGCACTTGGCCAGGTTTCTGCGGATGCT | 2772 |

TABLE B-continued

| Gene | Target Sequence Length | Amplicon Sequence | SEQ ID NO. |
|---|---|---|---|
| RAF1.3 | 73 | CGTCGTATGCGAGAGTCTGTTTCCAGGATGCCTGTTAGTTCTCAGCACAGATATTCTACACCTCACGCCTTCA | 2773 |
| RALBP1.1 | 84 | GGTGTCAGATATAAATGTGCAAATGCCTTCTTGCTGTCCTGTCGGTCTCAGTACGTTCACTTTATAGCTGCTGGCAATATCGAA | 2774 |
| RARB.2 | 78 | TGCCTGGACATCCTGATTCTTAGAATTTGCACCAGGTATACCCCAGAACAAGACACCATGACTTTCTCAGACGGCCTT | 2775 |
| RASSF1.1 | 75 | AGGGCACGTGAAGTCATTGAGGCCCTGCTGCGAAAGTTCTTGGTGGTGGATGACCCCCGCAAGTTTGCACTCTTT | 2776 |
| RB1.1 | 77 | CGAAGCCCTTACAAGTTTCCTAGTTCACCCTTACGGATTCCTGGAGGGAACATCTATATTTCACCCCTGAAGAGTCC | 2777 |
| RBM35A.1 | 66 | TGGTTTTGAATCACCAGGGCCGCCCATCAGGAGATGCCTTTATCCAGATGAAGTCTGCGGACAGAG | 2778 |
| REG4.1 | 83 | TGCTAACTCCTGCACAGCCCCGTCCTCTTCCTTTCTGCTAGCCTGGCTAAATCTGCTCATTATTTCAGAGGGGAAACCTAGCA | 2779 |
| RET.1 | 71 | GCCTGTGCAGTTCTTGTGCCCCAACATCAGCGTGGCCTACAGGCTCCTGGAGGGTGAGGGTCTGCCCTTCC | 2780 |
| RGS1.1 | 84 | TGCCCTGTAAAGCAGAAGAGATATATAAAGCATTTGTGCATTCAGATGCTGCTAAACAAATCAATATTGACTTCCGCACTCGAG | 2781 |
| RGS5.1 | 79 | TTCAAACGGAGGCTCCTAAAGAGGTGAATATTGACCACTTCACTAAGGACATCACAATGAAGAACCTGGTGGAACCTTC | 2782 |
| RHEB.2 | 78 | GATGATTGAGAACAGCCTTGCCTGTCACTGTCCTAGAACACCCTGGAGTTTAGTGTTCTGTGTCAGAGTCTTGGGAGC | 2783 |
| RhoB.1 | 67 | AAGCATGAACAGGACTTGACCATCTTTCCAACCCCTGGGGAAGACATTTGCAACTGACTTGGGGAGG | 2784 |
| rhoC.1 | 68 | CCCGTTCGGTCTGAGGAAGGCCGGGACATGGCGAACCGGATCAGTGCCTTTGGCTACCTTGAGTGCTC | 2785 |
| RIPK1.1 | 67 | AGTACCTTCAAGCCGGTCAAATTCAGCCACAGAACAGCCTGGTTCACTGCACAGTTCCCAGGGACTT | 2786 |
| RND3.1 | 66 | TCGGAATTGGACTTGGGAGGCGCGGTGAGGAGTCAGGCTTAAAACTTGTTGGAGGGGAGTAACCAG | 2787 |
| ROCK1.1 | 73 | TGTGCACATAGGAATGAGCTTCAGATGCAGTTGGCCAGCAAAGAGAGTGATATTGAGCAATTGCGTGCTAAAC | 2788 |
| ROCK2.1 | 66 | GATCCGAGACCCTCGCTCCCCATCAACGTGGAGAGCTTGCTGGATGGCTTAAATTCCTTGGTCCT | 2789 |
| RPLP1.1 | 68 | CAAGGTGCTCGGTCCTTCCGAGGAAGCTAAGGCTGCGTTGGGGTGAGGCCCTCACTTCATCCGGCGAC | 2790 |
| RPS23.1 | 67 | GTTCTGGTTGCTGGATTTGGTCGCAAAGGTCATGCTGTTGGTGATATTCCTGGAGTCCGCTTTAAGG | 2791 |
| RPS27A.1 | 74 | CTTACGGGGAAGACCATCACCCTCGAGGTTGAACCCTCGGATACGATAGAAAATGTAAAGGCCAAGATCCAGGA | 2792 |
| RPS6KAI.1 | 70 | GCTCATGGAGCTAGTGCCTCTGGACCCGGAGAATGGACAGACCTCAGGGGAAGAAGCTGGACTTCAGCCG | 2793 |
| RPS6KB1.3 | 81 | GCTCATTATGAAAAACATCCCAAACTTTAAAATGCGAAATTATTGGTTGGTGTGAAGAAAGCCAGACAACTTCTGTTTCTT | 2794 |
| RRM1.2 | 66 | GGGCTACTGGCAGCTACATTGCTGGGACTAATGGCAATTCCAATGGCCTTGTACCGATGCTGAGAG | 2795 |
| RRM2.1 | 71 | CAGCGGGATTAAACAGTCCTTTAACCAGCACAGCCAGTTAAAAGATGCAGCCTCACTGCTTCAACGCAGAT | 2796 |
| RUNX1.1 | 70 | AACAGAGACATTGCCAACCATATTGGATCTGCTTGCTGTCCAAACCAGCAAACTTTCCTGGGCAAATCAC | 2797 |

TABLE B-continued

| Gene | Target Sequence Length | Amplicon Sequence | SEQ ID NO. |
|---|---|---|---|
| S100A1.1 | 70 | TGGACAAGGTGATGAAGGAGCTAGACGAGAATGGAGACGGGGAGGTGGACTTCCAGGAGTATGTGGTGCT | 2798 |
| S100A10.1 | 77 | ACACCAAAATGCCATCTCAAATGGAACACGCCATGGAAACCATGATGTTTACATTTCACAAATTCGCTGGGGATAAA | 2799 |
| S100A2.1 | 73 | TGGCTGTGCTGGTCACTACCTTCCACAAGTACTCCTGCCAAGAGGGCGACAAGTTCAAGCTGAGTAAGGGGGA | 2800 |
| SAA2.2 | 72 | CTACAGCACAGATCAGCACCATGAAGCTTCTCACGGGCCTGGTTTTCTGCTCCTTGGTCCTGAGTGTCAGCA | 2801 |
| SCN4B.1 | 67 | GCCTTCCTGGAGTACCCGAGTGCTCCCTATGCCTTTCCAAGCATTTCTACTTGGGGAATTGGGCCCAC | 2802 |
| SCNN1A.2 | 66 | ATCAACATCCTGTCGAGGCTGCCAGAGACTCTGCCATCCCTGGAGGAGGACACGCTGGGCAACTTC | 2803 |
| SDHA.1 | 67 | GCAGAACTGAAGATGGGAAGATTTATCAGCGTGCATTTGGTGGACAGAGCCTCAAGTTTGGAAAGGG | 2804 |
| SDPR.1 | 66 | ACCAGCACAAGATGGAGCAGCGACAGATCAGTTTGGAGGGCTCCGTGAAGGGCATCCAGAATGACC | 2805 |
| SELE.1 | 71 | ACACTGGTCTGGCCTGCTACCTACCTGTGAAGCTCCCACTGAGTCCAACATTCCCTTGGTAGCTGGACTTT | 2806 |
| SELENBP1.1 | 67 | GGTACCAGCCTCGACACAATGTCATGATCAGCACTGAGTGGGCAGCTCCCAATGTCTTACGAGATGG | 2807 |
| SELL.1 | 67 | TGCAACTGTGATGTGGGGTACTATGGGCCCCAGTGTCAGTTTGTGATTCAGTGTGAGCCTTTGGAGG | 2808 |
| SELPLG.1 | 83 | TGGCCACTATCTTCTTCGTGTGCACTGTGGTGCTGGCGGTCCGCCTCTCCCGCAAGGGCCACATGTACCCCGTGCGTAATTAC | 2809 |
| SEMA3B.1 | 71 | GCTCCAGGATGTGTTTCTGTTGTCCTCGCGGGACCACCGGACCCCGCTGCTCTATGCCGTCTTCTCCACGT | 2810 |
| SEMA3C.1 | 66 | ATGGCCATTCCTGTTCCAGATTCTACCCAACTGGGAAACGGAGGAGCCGAAGACAAGATGTGAGAC | 2811 |
| SEMA3F.3 | 86 | CGCGAGCCCCTCATTATACACTGGGCAGCCTCCCCACAGCGCATCGAGGAATGCGTGCTCTCAGGCAAGGATGTCAACGGCGAGTG | 2812 |
| SEMA5B.1 | 67 | CTCGAGGACAGCTCCAACATGAGCCTCTGGACCCAGAACATCACCGCCTGTCCTGTGCGGAATGTGA | 2813 |
| SERPINA5.1 | 66 | CAGCATGGTAGTGGCAAAGAGAGGTCCAGAGTCCTGGCCCTTGATGCCCAGCTCAGTGCCACAAAG | 2814 |
| SFN.1 | 70 | GAGAGAGCCAGTCTGATCCAGAAGGCCAAGCTGGCAGAGCAGGCCGAACGCTATGAGGACATGGCAGCCT | 2815 |
| SGK.1 | 73 | TCCGCAAGACACCTCCTGGAGGGCCTCCTGCAGAAGGACAGGACAAAGCGGCTCGGGGCCAAGGATGACTTCA | 2816 |
| SHANK3.1 | 68 | CTGTGCCCTCTACAACCAGGAGAGCTGTGCTCGTGTCCTGCTCTTCCGTGGAGCTAACAGGGATGTCC | 2817 |
| SHC1.1 | 71 | CCAACACCTTCTTGGCTTCTGGGACCTGTGTTCTTGCTGAGCACCCTCTCCGGTTTGGGTTGGGATAACAG | 2818 |
| SILV.1 | 66 | CCGCATCTTCTGCTCTTGTCCCATTGGTGAGAATAGCCCCCTCCTCAGTGGGCAGCAGGTCTGAGT | 2819 |
| SKIL.1 | 66 | AGAGGCTGAATATGCAGGACAGTTGGCAGAACTGAGGCAGAGATTGGACCATGCTGAGGCCGATAG | 2820 |
| SLC13A3.1 | 66 | CTTGCCCTCCAACAAGGTCTGCCCCCAGTACTTCCTCGACACCAACTTCCTCTTCCTCAGTGGGCT | 2821 |
| SLC16A3.1 | 68 | ATGCGACCCACGTCTACATGTACGTGTTCATCCTGGCGGGGGCCGAGGTGCTCACCTCCTCCCTGATT | 2822 |

TABLE B-continued

| Gene | Target Sequence Length | Amplicon Sequence | SEQ ID NO. |
|---|---|---|---|
| SLC22A3.1 | 66 | ATCGTCAGCGAGTTTGACCTTGTCTGTGTCAATGCGTGGATGCTGGACCTCACCCAAGCCATCCTG | 2823 |
| SLCC22A6.1 | 68 | TCCGCCACCTCTTCCTCTGCCTCTCCATGCTGTGGTTTGCCACTAGCTTTGCATACTATGGGCTGGTC | 2824 |
| SLC2A1.1 | 67 | GCCTGAGTCTCCTGTGCCCACATCCCAGGCTTCACCCTGAATGGTTCCATGCCTGAGGGTGGAGACT | 2825 |
| SLC23A1.1 | 66 | GCTGAGACCCACTGACCTGCAGACCTCATAGTGGGTGCCCAGGATGTTGTCCTACGGAGAGAGGCT | 2826 |
| SLC7A5.2 | 70 | GCGCAGAGGCCAGTTAAAGTAGATCACCTCCTCGAACCCACTCCGGTTCCCCGCAACCCACAGCTCAGCT | 2827 |
| SLC9A1.1 | 67 | CTTCGAGATCTCCCTCTGGATCCTTCTGGCCTGCCTCATGAAGATAGGTTTCCATGTGATCCCCACT | 2828 |
| SLIT2.2 | 67 | TTTACCGATGCACCTGTCCATATGGTTTCAAGGGGCAGGACTGTGATGTCCCAATTCATGCTGCAT | 2829 |
| SNAI1.1 | 69 | CCCAATCGGAAGCCTAACTACAGCGAGCTGCAGGACTCTAATCCAGAGTTTACCTTCCAGCAGCCCTAC | 2830 |
| SNRK.1 | 71 | GAGGAAAAGTCAGGGCCGGGGCTCCAGCTGCAGTAGTTCGGAGACCAGTGATGATGATTCTGAAAGCCGGC | 2831 |
| SOD1.1 | 70 | TGAAGAGAGGCATGTTGGAGACTTGGGCAATGTGACTGCTGACAAAGATGGTGTGGCCGATGTGTCTATT | 2832 |
| SP3.1 | 69 | TCAAGAGTCTCAGCAGCCAACCAGTCAAGCCCAAATTGTGCAAGGTATTACACCACAGACAATCCATGG | 2833 |
| SPARC.1 | 73 | TCTTCCCTGTACACTGGCAGTTCGGCCAGCTGGACCAGCACCCCATTGACGGGTACCTCTCCCACACCGAGCT | 2834 |
| SPARCL1.1 | 67 | GGCACAGTGCAAGTGATGACTACTTCATCCCAAGCCAGGCCTTTCTGGAGGCCGAGAGAGCTCAATC | 2835 |
| SPAST.1 | 66 | CCTGAGTTGTTCACAGGGCTTAGAGCTCCTGCCAGAGGGCTGTTACTCTTTGGTCCACCTGGGAAT | 2836 |
| SPHK1.1 | 67 | GGCAGCTTCCTTGAACCATTATGCTGGCTATGAGCAGGTCACCAATGAAGACCTCCTGACCAACTGC | 2837 |
| SPRY1.1 | 77 | CAGACCAGTCCCTGGTCATAGGTCTGAAAGGGCAATCCGGACCCAGCCCAAGCAACTGATTGTGGATGACTTGAAGG | 2838 |
| SQSTM1.1 | 69 | GGACCCGTCTACAGGTGAACTCCAGTCCCTACAGATGCCAGAATCCGAAGGGCCAAGCTCTCTGGACCC | 2839 |
| STAT1.3 | 81 | GGGCTCAGCTTTCAGAAGTGCTGAGTTGGCAGTTTTCTTCTGTCACCAAAAGAGGTCTCAATGTGGACCAGCTGAACATGT | 2840 |
| STAT3.1 | 70 | TCACATGCCACTTTGGTGTTTCATAATCTCCTGGGAGAGATTGACCAGCAGTATAGCCGCTTCCTGCAAG | 2841 |
| STAT5A.1 | 77 | GAGGCGCTCAACATGAAATTCAAGGCCGAAGTGCAGAGCAACCGGGGCCTGACCAAGGAGAACCTCGTGTTCCTGGC | 2842 |
| STAT5B.2 | 74 | CCAGTGGTGGTGATCGTTCATGGCAGCCAGGACAACAATGCGACGGCCACTGTTCTCTGGGACAATGCTTTTGC | 2843 |
| STC2.1 | 67 | AAGGAGGCCATCACCCACAGCGTGCAGGTTCAGTGTGAGCAGAACTGGGGAAGCCTGTGCTCCATCT | 2844 |
| STK11.1 | 66 | GGACTCGGAGACGCTGTGCAGGAGGGCCGTCAAGATCCTCAAGAAGAAGAAGTTGCGAAGGATCCC | 2845 |
| STK15.2 | 69 | CATCTTCCAGGAGGACCACTCTCTGTGGCACCCTGGACTACCTGCCCCCTGAAATGATTGAAGGTCGGA | 2846 |
| STK4.1 | 66 | GAGCCATCTTCCTGCAACTTTACCTCTTTCCCTCAGATGGGGAGCCATGACTGGGTTGCACCTCAG | 2847 |

TABLE B-continued

| Gene | Target Sequence Length | Amplicon Sequence | SEQ ID NO. |
|---|---|---|---|
| STMY3.3 | 90 | CCTGGAGGCTGCAACATACCTCAATCCTGTCCCAGGCCGGATCCTCCTGAAGCCCTTTTCG CAGCACTGCTATCCTCCAAAGCCATTGTA | 2848 |
| SUYCLG1.1 | 66 | CCAAGCCTGTAGTGTCCTTCATTGCTGGTTTAACTGCTCCTCCTGGGAGAAGAATGGGTCA TGCCG | 2849 |
| SULT1C2.1 | 67 | GGGACCCAAAGCATGAAATTCGGAAGGTGATGCAGTTCATGGGAAAGAAGGTGGATGAAAC AGTGCT | 2850 |
| SURV.2 | 80 | TGTTTTGATTCCCGGGCTTACCAGGTGAGAAGTGAGGGAGGAAGAAGGCAGTGTCCCTTTT GCTAGAGCTGACAGCTTTG | 2851 |
| TACSTD2.1 | 80 | ATCACCAACCGGAGAAAGTCGGGGAAGTACAAGAAGGTGGAGATCAAGGAACTGGGGGAGT TGAGAAAGGAACCGAGCTT | 2852 |
| TAGLN.1 | 73 | GATGGAGCAGGTGGCTCAGTTCCTGAAGGCGGCTGAGGACTATGGGGTCATCAAGACTGAC ATGTTCCAGACT | 2853 |
| TAP1.1 | 72 | GTATGCTGCTGAAAGTGGGAATCCTCTACATTGGTGGGCAGCTGGTGACCAGTGGGCTGT AAGCAGTGGGA | 2854 |
| TCF4.1 | 67 | CACACCCTGGAATGGGAGACGCATCGAATCACATGGGACAGATGTAAAAGGGTCCAAGTTG CCACAT | 2855 |
| TCOF1.2 | 66 | AGCGAGGATGAGGACGTGATCCCCGCTACACAGTGCTTGACTCCTGGCATCAGAACCAATG TGGTG | 2856 |
| TEK.1 | 76 | ACTTCGGTGCTACTTAACAACTTACATCCCAGGGAGCAGTACGTGGTCCGAGCTAGAGTCA ACACCAAGGCCCAGG | 2857 |
| TERT.1 | 85 | GACATGGAGAACAAGCTGTTTGCGGGGATTCGGCGGGACGGGCTGCTCCTGCGTTTGGTGG ATGATTTCTTGTTGGTGACACCTC | 2858 |
| TFAP2B.1 | 67 | CGTGTGACGTGCGAGAGACGCGATGGACGCGCCTTGCTCTTACTGTGCAGGTCCTGAGAGC GTGTGG | 2859 |
| TFAP2C.1 | 68 | CATGCCTCACCAGATGGACGAGGTGCAGAATGTCGACGACCAGCACCTGTTGCTGCACGAT CAGACAG | 2860 |
| TFPI.1 | 69 | CCGAATGGTTTCCAGGTGGATAATTATGGAACCCAGCTCAATGCTGTGAATAACTCCCTGA CTCCGCAA | 2861 |
| TGFA.2 | 83 | GGTGTGCCACAGACCTTCCTACTTGGCCTGTAATCACCTGTGCAGCCTTTTGTGGGCCTTC AAAACTCTGTCAAGAACTCCGT | 2862 |
| TGFb1.1 | 80 | CTGTATTTAAGGACACCCGTGCCCCAAGCCCACCTGGGGCCCCATTAAAGATGGAGAGAGG ACTGCGGATCTCTGTGTCA | 2863 |
| TGFB2.2 | 75 | ACCAGTCCCCCAGAAGACTATCCTGAGCCCGAGGAAGTCCCCCCGGAGGTGATTTCCATCT ACAACAGCACCAGG | 2864 |
| TGFBI.1 | 67 | GCTACGAGTGCTGTCCTGGATATGAAAAGGTCCCTGGGGAGAAGGGCTGTCCAGCAGCCCT ACCACT | 2865 |
| TGFBR1.1 | 67 | GTCATCACCTGGCCTTGGTCCTGTGGAACTGGCAGCTGTCATTGCTGGACCAGTGTGCTTC GTCTGC | 2866 |
| TGFBR2.3 | 66 | AACACCAATGGGTTCCATCTTTCTGGGCTCCTGATTGCTCAAGCACAGTTTGGCCTGATGA AGAGG | 2867 |
| THBD.1 | 68 | AGATCTGCGACGGACTGCGGGGCCACCTAATGACAGTGCGCTCCTCGGTGGCTGCCGATGT CATTTCC | 2868 |
| THBS1.1 | 85 | CATCCGCAAAGTGACTGAAGAGAACAAAGAGTTGGCCAATGAGCTGAGGCGGCCTCCCCTA TGCTATCACAACGGAGTTCAGTAC | 2869 |
| TIMP1.1 | 76 | TCCCTGCGGTCCCAGATAGCCTGAATCCTGCCCGGAGTGGAAGCTGAAGCCTGCACAGTGT CCACCCTGTTCCCAC | 2870 |
| TIMP2.1 | 69 | TCACCCTCTGTGACTTCATCGTGCCCTGGGACACCCTGAGCACCACCCAGAAGAAGAGCCT GAACCACA | 2871 |
| TIMP3.3 | 67 | CTACCTGCCTTGCTTTGTGACTTCCAAGAACGAGTGTCTCTGGACCGACATGCTCTCCAAT TTCGGT | 2872 |

TABLE B-continued

| Gene | Target Sequence Length | Amplicon Sequence | SEQ ID NO. |
|---|---|---|---|
| TK1.2 | 84 | GCCGGGAAGACCGTAATTGTGGCTGCACTGGATGGGACCTTCCAGAGGAAGCCATTTGGGG CCATCCTGAACCTGGTGCCGCTG | 2873 |
| TLR3.1 | 71 | GGTTGGGCCACCTAGAAGTACTTGACCTGGGCCTTAATGAAATTGGGCAAGAACTCACAGG CCAGGAATGG | 2874 |
| TMEM27.1 | 75 | CCCTGAAAGAATGTTGTGGCTGCTCTTTTTTCTGGTGACTGCCATTCATGCTGAACTCTGT CAACCAGGTGCAGA | 2875 |
| TMEM47.1 | 71 | GGATTCCACTGTTAGAGCCCTTACCGCCTGCTTATCCTACCCAATGACTACATTGGCTGTT GGTTATTTGC | 2876 |
| TMSB10.1 | 68 | GAAATCGCCAGCTTCGATAAGGCCAAGCTGAAGAAAACGGAGACGCAGGAGAAGAACACCC TGCCGAC | 2877 |
| TNF.1 | 69 | GGAGAAGGGTGACCGACTCAGCGCTGAGATCAATCGGCCCGACTATCTCGACTTTGCCGAG TCTGGGCA | 2878 |
| TNFAIP3.1 | 68 | ATCGTCTTGGCTGAGAAAGGGAAAAGACACACAAGTCGCGTGGGTTGGAGAAGCCAGAGCC ATTCCAC | 2879 |
| TNFAIP6.1 | 67 | AGGAGTGAAAGATGGGATGCCTATTGCTACAACCCACACGCAAAGGAGTGTGGTGGCGTCT TTACAG | 2880 |
| TNFRSF10C.3 | 67 | GGAGTTTGACCAGAGATGCAAGGGGTGAAGGAGCGCTTCCTACCGTTAGGGAACTCTGGGG ACAGAG | 2881 |
| TNFRSF10D.1 | 66 | CCTCTCGCTTCTGGTGGTCTGTGAACTGAGTCCCTGGGATGCCTTTTAGGGCAGAGATTCC TGAGC | 2882 |
| TNFRSF11B.1 | 67 | TGGCGACCAAGACACCTTGAAGGGCCTAATGCACGCACTAAAGCACTCAAAGACGTACCAC TTTCCC | 2883 |
| TNFRSF1A.1 | 71 | ACTGCCCTGAGCCCAAATGGGGAGTGAGAGGCCATAGCTGTCTGGCATGGGCCTCTCCAC CGTGCCTGAC | 2884 |
| TNFSF12.1 | 68 | TAGGCCAGGAGTTCCCAAATGTGAGGGGCGAGAAACAAGACAAGCTCCTCCCTTGAGAATT CCCTGTG | 2885 |
| TNFSF13B.1 | 80 | CCTACGCCATGGGACATCTAATTCAGAGGAAGAAGGTCCATGTCTTTGGGGATGAATTGAG TCTGGTGACTTTGTTTCGA | 2886 |
| TNFSF7.1 | 67 | CCAACCTCACTGGGACACTTTTGCCTTCCCGAAACACTGATGAGACCTTCTTTGGAGTGCA GTGGGT | 2887 |
| TNIP2.1 | 66 | CATGTCAGAAAGGGCCGATCGGGAACGGGCTCAAAGTAGGATTCAAGAACTGGAGGAAAAG GTCGC | 2888 |
| TOP2A.4 | 72 | AATCCAAGGGGGAGAGTGATGACTTCCATATGGACTTTGACTCAGCTGTGGCTCCTCGGGC AAAATCTGTAC | 2889 |
| TOP2B.2 | 66 | TGTGGACATCTTCCCCTCAGACTTCCCTACTGAGCCACCTTCTCTGCCACGAACCGGTCGG GCTAG | 2890 |
| TP.3 | 82 | CTATATGCAGCCAGAGATGTGACAGCCACCGTGGACAGCCTGCCACTCATCACAGCCTCCA TTCTCAGTAAGAAACTCGTGG | 2891 |
| TRAIL.1 | 73 | CTTCACAGTGCTCCTGCAGTCTCTCTGTGTGGCTGTAACTTACGTGTACTTTACCAACGAG CTGAAGCAGATG | 2892 |
| TS.1 | 65 | GCCTCGGTGTGCCTTTCAACATCGCCAGCTACGCCCTGCTCACGTACATGATTGCGCACAT CACG | 2893 |
| TSC1.1 | 66 | TCACCAAATCTCAGCCCGCTTTCCTCATCGTTCAGCCGATGTCACCACCAGCCCTTATGCT GACAC | 2894 |
| TSC2.1 | 69 | CACAGTGGCCTCTTTCTCCTCCCTGTACCAGTCCAGCTGCCAAGGACAGCTGCACAGGAGC GTTTCCTG | 2895 |
| TSPAN7.2 | 67 | ATCACTGGGGTGATCCTGCTGGCTGTTGGAGTCTGGGGCAAACTTACTCTGGGCACCTATA TCTCCC | 2896 |
| TSPAN8.1 | 83 | CAGAAATCTCTGCAGGCAAGTTGCTCCAGAGCATATTGCAGGACAAGCCTGTAACGAATAG TTAAATTCACGGCATCTGGATT | 2897 |

TABLE B-continued

| Gene | Target Sequence Length | Amplicon Sequence | SEQ ID NO. |
|---|---|---|---|
| TUBB.1 | 73 | CGAGGACGAGGCTTAAAAACTTCTCAGATCAATCGTGCATCCTTAGTGAACTTCTGTTGTCCTCAAGCATGGT | 2898 |
| TUSC2.1 | 68 | CACCAAGAACGGGCAGAAGCGGGCCAAGCTGAGGCGAGTGCATAAGAATCTGATTCCTCAGGGCATCG | 2899 |
| tusc4.2 | 68 | GGAGGAGCTAAATGCCTCAGGCCGGTGCACTCTGCCCATTGATGAGTCCAACACCATCCACTTGAAGG | 2900 |
| TXLNA.1 | 68 | GCCAGAACGGCTCAGTCTGGGGCCCTTCGTGATGTCTCTGAGGAGCTGAGCCGCCAACTGGAAGACAT | 2901 |
| UBB.1 | 522 | GAGTCGACCCTGCACCTGGTCCTGCGTCTGAGAGGTGGTATGCAGATCTTCGTGAAGACCCTGACCGGCAAGACCATCACCCTGGAAGTGGAGCCCAGTGACACCATCGAAAATGTGAAGGCCAAGATCCAGGATAAAGAAGGCATCCCTCCCGACCAGCAGAGGCTCATCTTTGCAGGCAAGCAGCTGGAAGATGGCCGCACTCTTTCTGACTACAACATCCAGAAGGAGTCGACCCTGCACCTGGTCCTGCGTCTGAGAGGTGGTATGCAGATCTTCGTGAAGACCCTGACCGGCAAGACCATCACTCTGGAAGTGGAGCCCAGTGACACCATCGAAAATGTGAAGGCCAAGATCCAAGATAAAGAAGGCATCCCTCCCGACCAGCAGAGGCTCATCTTTGCAGGCAAGCAGCTGGAAGATGGCCGCACTCTTTCTGACTACAACATCCAGAAGGAGTCGACCCTGCACCTGGTCCTGCGCCTGAGGGGTGGCTGTTAATTCTTCAGTCATGGCATTCGC | 2902 |
| UBE1C.1 | 76 | GAATGCACGCTGGAACTTTATCCACCACAGGTTAATTTTCCCATGTGCACCATTGCATCTATGCCCAGGCTACCAG | 2903 |
| UBE2C.1 | 67 | TGTCTGGCGATAAAGGGATTTCTGCCTTCCCTGAATCAGACAACCTTTTCAAATGGGTAGGGACCAT | 2904 |
| UBE2T.1 | 67 | TGTTCTCAAATTGCCACCAAAAGGTGCTTGGAGACCATCCCTCAACATCGCAACTGTGTTGACCTCT | 2905 |
| UGCG.1 | 73 | GGCAACTGACAAACAGCCTTATAGCAAGCTCCCAGGTGTCTCTCTTCTGAAACCACTGAAAGGGGTAGATCCT | 2906 |
| UMOD.1 | 66 | GCGTGGACCTGGATGAGTGCGCCATTCCTGGAGCTCACAACTGCTCCGCCAACAGCAGCTGCGTAA | 2907 |
| upa.3 | 70 | GTGGATGTGCCCTGAAGGACAAGCCAGGCGTCTACACGAGAGTCTCACACTTCTTACCCTGGATCCGCAG | 2908 |
| USP34.1 | 70 | AAGCTGTGATGGCCAAGCTTTGCCCTCCCAGGACCCTGAGGTTGCTTTATCTCTCAGTTGTGGCCATTCC | 2909 |
| VCAM1.1 | 89 | TGGCTTCAGGAGCTGAATACCCTCCCAGGCACACACAGGTGGGACACAAATAAGGGTTTTGGAACCACTATTTTCTCATCACGACAGCA | 2910 |
| VCAN.1 | 69 | CCTGCTACACAGCCAACAAGACCACCCACTGTGGAAGACAAAGAGGCCTTTGGACCTCAGGCGCTTTCT | 2911 |
| VDR.2 | 67 | GCCCTGGATTTCAGAAAGAGCCAAGTCTGGATCTGGGACCCTTTCCTTCCTTCCCTGGCTTGTAACT | 2912 |
| VEGF.1 | 71 | CTGCTGTCTTGGGTGCATTGGAGCCTTGCCTTGCTGCTCTACCTCCACCATGCCAAGTGGTCCCAGGCTGC | 2913 |
| BEGFB.1 | 71 | TGACGATGGCCTGGAGTGTGTGCCCACTGGGCAGCACCAAGTCCGGATGCAGATCCTCATGATCCGGTACC | 2914 |
| VHL.1 | 67 | CGGTTGGTGACTTGTCTGCCTCCTGCTTTGGGAAGACTGAGGCATCCGTGAGGCAGGGACAAGTCTT | 2915 |
| VIM.3 | 72 | TGCCCTTAAAGGAACCAATGAGTCCCTGGAACGCCAGATGCGTGAAATGGAAGAGAACTTTGCCGTTGAAGC | 2916 |
| VTCN1.1 | 70 | ACAGTGGTCTGGGCATCCCAAGTTGACCAGGGAGCCAACTTCTCGGAAGTCTCCAATACCAGCTTTGAGC | 2917 |
| VTN.1 | 67 | AGTCAATCTTCGCACACGGCGAGTGGACACTGTGGACCCTCCCTACCCACGCTCCATCGCTCAGTAC | 2918 |
| VWF.1 | 66 | TGAAGCACAGTGCCCTCTCCGTCGAGCTGCACAGTGACATGGAGGTGACGGTGAATGGGAGACTGG | 2919 |
| WIF.1 | 67 | AACAAGCTGAGTGCCCAGGCGGGTGCCGAAATGGAGGCTTTTGTAATGAAAGACGCATCTGCGAGTG | 2920 |

TABLE B-continued

| Gene | Target Sequence Length | Amplicon Sequence | SEQ ID NO. |
|---|---|---|---|
| WISP1.1 | 75 | AGAGGCATCCATGAACTTCACACTTGCGGGCTGCATCAGCACACGCTCCTATCAACCCAAGTACTGTGGAGTTTG | 2921 |
| WT1.1 | 66 | TGTACGGTCGGCATCTGAGACCAGTGAGAAACGCCCCTTCATGTGTGCTTACCCAGGCTGCAATAA | 2922 |
| WWOX.5 | 74 | ATCGCAGCTGGTGGGTGTACACACTGCTGTTTACCTTGGCGAGGCCTTTCACCAAGTCCATGCAACAGGGAGCT | 2923 |
| XDH.1 | 66 | TGGTGGCAGACATCCCTTCCTGGCCAGATACAAGGTTGGCTTCATGAAGACTGGGACAGTTGTGGC | 2924 |
| XIAP.1 | 77 | GCAGTTGGAAGACACAGGAAAGTATCCCCAAATTGCAGATTTATCAACGGCTTTTATCTTGAAAATAGTGCCACGCA | 2925 |
| SPNPEP2.2 | 72 | CACCCTGCACTGAACATACCCCAAGAGCCCCTGCTGGCCCATTGCCTAGAAACCTTTGCATTCATCCTCCTT | 2926 |
| YB-1.2 | 76 | AGACTGTGGAGTTTGATGTTGTTGAAGGAGAAAAGGGTGCGGAGGCAGCAAATGTTACAGGTCCTGGTGGTGTTCC | 2927 |
| ZHX2.1 | 67 | GAGTACGACCAGTTAGCGGCCAAGACTGGCCTGGTCCGAACTGAGATTGTGCGTTGGTTCAAGGAGA | 2928 |

SEQUENCE LISTING (2928 sequences)

SEQ ID NO: 1 - DNA, 23 bp, Artificial Sequence
  Synthetic primer
cgttccgatcctctatactgcat

SEQ ID NO: 2 - DNA, 18 bp, Artificial Sequence
  Synthetic primer
ctctcccgccttcctagc

SEQ ID NO: 3 - DNA, 20 bp, Artificial Sequence
  Synthetic primer
gtgtggcaggtggacactaa

SEQ ID NO: 4 - DNA, 20 bp, Artificial Sequence
  Synthetic primer
aaacaccactggagcattga

SEQ ID NO: 5 - DNA, 18 bp, Artificial Sequence
  Synthetic primer
tggcggagaactagccat

SEQ ID NO: 6 - DNA, 19 bp, Artificial Sequence
  Synthetic primer
ccgctgtacgaggatttca

SEQ ID NO: 7 - DNA, 20 bp, Artificial Sequence
  Synthetic primer
tacaatgagaggctctgggc

SEQ ID NO: 8 - DNA, 20 bp, Artificial Sequence
  Synthetic primer
gaagtgccaggaggcgatta

SEQ ID NO: 9 - DNA, 18 bp, Artificial Sequence
  Synthetic primer
gtcactgtgtccagccca

SEQ ID NO: 10 - DNA, 21 bp, Artificial Sequence
  Synthetic primer
ggacaggtgcaagctcatctg

SEQ ID NO: 11 - DNA, 18 bp, Artificial Sequence
  Synthetic primer
gagaatgtctgccgctgg

SEQ ID NO: 12 - DNA, 20 bp, Artificial Sequence
  Synthetic primer
tttgacaagtgcatggtgtg

SEQ ID NO: 13 - DNA, 20 bp, Artificial Sequence
  Synthetic primer
cactgtggctcacgaaatcg

SEQ ID NO: 14 - DNA, 20 bp, Artificial Sequence
  Synthetic primer
gcgagttcaaagtgttcgag

SEQ ID NO: 15 - DNA, 20 bp, Artificial Sequence
  Synthetic primer
gcacaggttacacaacccaa

SEQ ID NO: 16 - DNA, 18 bp, Artificial Sequence
  Synthetic primer
gtctacccagcagctccg

SEQ ID NO: 17 - DNA, 19 bp, Artificial Sequence
  Synthetic primer
aagaccatcacctccgtgg

SEQ ID NO: 18 - DNA, 20 bp, Artificial Sequence
  Synthetic primer
aagccaacaaaccttccttc

SEQ ID NO: 19 - DNA, 21 bp, Artificial Sequence
  Synthetic primer
tgttggggagtaaacacttgg

SEQ ID NO: 20 - DNA, 18 bp, Artificial Sequence
  Synthetic primer
taagccacaagcacacgg

SEQ ID NO: 21 - DNA, 22 bp, Artificial Sequence
  Synthetic primer
agccaacatgtgactaattgga

SEQ ID NO: 22 - DNA, 20 bp, Artificial Sequence
  Synthetic primer
gatccagcctcactatgcct

SEQ ID NO: 23 - DNA, 20 bp, Artificial Sequence
  Synthetic primer
agcattgatcgatacctggc

SEQ ID NO: 24 - DNA, 19 bp, Artificial Sequence
  Synthetic primer
gcggcatagagaccgactt

SEQ ID NO: 25 - DNA, 22 bp, Artificial Sequence
  Synthetic primer
gacgttcagctaccctgacttt

SEQ ID NO: 26 - DNA, 20 bp, Artificial Sequence
  Synthetic primer
cgcttctatggcgctgagat

SEQ ID NO: 27 - DNA, 19 bp, Artificial Sequence
  Synthetic primer
tcctgccacccttcaaacc

SEQ ID NO: 28 - DNA, 25 bp, Artificial Sequence
  Synthetic primer
ttgtctctgccttggactatctaca

SEQ ID NO: 29 - DNA, 20 bp, Artificial Sequence
  Synthetic primer
ggacagggtaagaccgtgat

SEQ ID NO: 30 - DNA, 20 bp, Artificial Sequence
  Synthetic primer
ggctctttcaacagcagtcc

SEQ ID NO: 31 - DNA, 18 bp, Artificial Sequence
  Synthetic primer
gcctgtacgtgccagctc

SEQ ID NO: 32 - DNA, 20 bp, Artificial Sequence
  Synthetic primer
ccctctaccagaaggacagc

SEQ ID NO: 33 - DNA, 20 bp, Artificial Sequence
  Synthetic primer
agttcctcaatggtgccaac

SEQ ID NO: 34 - DNA, 19 bp, Artificial Sequence
  Synthetic primer
gagctgcaggacttcgtga

SEQ ID NO: 35 - DNA, 22 bp, Artificial Sequence
  Synthetic primer
ggacagtcagttttagggttgc

SEQ ID NO: 36 - DNA, 20 bp, Artificial Sequence
  Synthetic primer
tctacttggggtgacagtgc

SEQ ID NO: 37 - DNA, 20 bp, Artificial Sequence
  Synthetic primer
ccgtgaaagctgctctgtaa

SEQ ID NO: 38 - DNA, 18 bp, Artificial Sequence
  Synthetic primer
gccatctgcgtcaactcc

SEQ ID NO: 39 - DNA, 20 bp, Artificial Sequence
  Synthetic primer
gttgcgattactggcaatgt

SEQ ID NO: 40 - DNA, 20 bp, Artificial Sequence
  Synthetic primer
atgacctcagatggaggctg

SEQ ID NO: 41 - DNA, 20 bp, Artificial Sequence
  Synthetic primer
ctgcacagactccaacctca

SEQ ID NO: 42 - DNA, 20 bp, Artificial Sequence
  Synthetic primer
ctccaggtgtacctccaacc

SEQ ID NO: 43 - DNA, 22 bp, Artificial Sequence
  Synthetic primer
gcccctatcctaccttcaatcc

SEQ ID NO: 44 - DNA, 23 bp, Artificial Sequence
  Synthetic primer
caagacactaagggcgactacca

SEQ ID NO: 45 - DNA, 19 bp, Artificial Sequence
  Synthetic primer
tgggagggatgaaggaaat

SEQ ID NO: 46 - DNA, 20 bp, Artificial Sequence
  Synthetic primer
gctcaagcctggaagatgac

SEQ ID NO: 47 - DNA, 20 bp, Artificial Sequence
  Synthetic primer
gactgcaaagatggaaacga

SEQ ID NO: 48 - DNA, 18 bp, Artificial Sequence
  Synthetic primer
acaacgaccgcaccatct

SEQ ID NO: 49 - DNA, 20 bp, Artificial Sequence
  Synthetic primer
cacaaggaagaagctggtga

SEQ ID NO: 50 - DNA, 20 bp, Artificial Sequence
  Synthetic primer
ggacagcaggaatgtgtttc

SEQ ID NO: 51 - DNA, 20 bp, Artificial Sequence
  Synthetic primer
ccagcctgataaaggtcctg

SEQ ID NO: 52 - DNA, 18 bp, Artificial Sequence
  Synthetic primer
gcctcaagagctggttcg

SEQ ID NO: 53 - DNA, 19 bp, Artificial Sequence
  Synthetic primer
cggaccaagaactgtgacc

SEQ ID NO: 54 - DNA, 18 bp, Artificial Sequence
  Synthetic primer
gagcagctggagtctcgg

SEQ ID NO: 55 - DNA, 19 bp, Artificial Sequence
  Synthetic primer
gcttgctgtatgacccctg

SEQ ID NO: 56 - DNA, 27 bp, Artificial Sequence
  Synthetic primer
tgtgagtgaaatgccttctagtagtga

SEQ ID NO: 57 - DNA, 20 bp, Artificial Sequence
  Synthetic primer
cagtagagatccccgcaact

SEQ ID NO: 58 - DNA, 18 bp, Artificial Sequence
  Synthetic primer
gcatgggctactgcatcc

SEQ ID NO: 59 - DNA, 18 bp, Artificial Sequence
  Synthetic primer
actctgcttcccaagggc

SEQ ID NO: 60 - DNA, 18 bp, Artificial Sequence
  Synthetic primer
ggtcctccgtcggttctc

SEQ ID NO: 61 - DNA, 20 bp, Artificial Sequence
  Synthetic primer
tggtccctagaacaagaggc

SEQ ID NO: 62 - DNA, 19 bp, Artificial Sequence
  Synthetic primer
tgcaggaacgcctcatcaa

SEQ ID NO: 63 - DNA, 20 bp, Artificial Sequence
  Synthetic primer
cccccagataaaggtcattg

SEQ ID NO: 64 - DNA, 20 bp, Artificial Sequence
  Synthetic primer
agaacgcctatttggagctg

SEQ ID NO: 65 - DNA, 18 bp, Artificial Sequence
  Synthetic primer
ccgctttcgctacagcat

SEQ ID NO: 66 - DNA, 18 bp, Artificial Sequence
  Synthetic primer
aaccatggggaacgtctg

SEQ ID NO: 67 - DNA, 20 bp, Artificial Sequence
  Synthetic primer
ttgcagccctgtcttcctac

SEQ ID NO: 68 - DNA, 18 bp, Artificial Sequence
  Synthetic primer
ccgaggccctgacttctt

SEQ ID NO: 69 - DNA, 22 bp, Artificial Sequence
  Synthetic primer
ggctcttgtgcgtactgtcctt

SEQ ID NO: 70 - DNA, 20 bp, Artificial Sequence
  Synthetic primer
gggatcgagacatgtaagca

SEQ ID NO: 71 - DNA, 19 bp, Artificial Sequence
  Synthetic primer
gggtcaggggcctcgagat

SEQ ID NO: 72 - DNA, 23 bp, Artificial Sequence
  Synthetic primer
cgttgtcagcacttggaatacaa

SEQ ID NO: 73 - DNA, 19 bp, Artificial Sequence
  Synthetic primer
ctaggggcaaaaagcatga

SEQ ID NO: 74 - DNA, 20 bp, Artificial Sequence
  Synthetic primer
ccattcccaccattctacct

SEQ ID NO: 75 - DNA, 18 bp, Artificial Sequence
  Synthetic primer
ccgccgtggacacagact

SEQ ID NO: 76 - DNA, 20 bp, Artificial Sequence
  Synthetic primer
cctggagggtcctgtacaat

SEQ ID NO: 77 - DNA, 25 bp, Artificial Sequence
  Synthetic primer
cagatggacctagtacccactgaga

SEQ ID NO: 78 - DNA, 20 bp, Artificial Sequence
  Synthetic primer
ccagcctccatgtatcatca

SEQ ID NO: 79 - DNA, 18 bp, Artificial Sequence
  Synthetic primer
aacccacccctgtcttgg

SEQ ID NO: 80 - DNA, 24 bp, Artificial Sequence
  Synthetic primer
cttttgtggaactctatgggaaca

SEQ ID NO: 81 - DNA, 26 bp, Artificial Sequence
  Synthetic primer
tgtactggcgaagaatatttggtaaa

SEQ ID NO: 82 - DNA, 24 bp, Artificial Sequence
  Synthetic primer
ccaggaagaatgcttaagatgtga

SEQ ID NO: 83 - DNA, 18 bp, Artificial Sequence
  Synthetic primer
gagctccgcaaggatgac

SEQ ID NO: 84 - DNA, 18 bp, Artificial Sequence
  Synthetic primer
aggaagatccctcgcagc

SEQ ID NO: 85 - DNA, 23 bp, Artificial Sequence
  Synthetic primer
attcctatggctctgcaattgtc

SEQ ID NO: 86 - DNA, 20 bp, Artificial Sequence
  Synthetic primer
cctgcaaaagggaacaagag

SEQ ID NO: 87 - DNA, 20 bp, Artificial Sequence
  Synthetic primer
gaccaagcaggaagctcaga

SEQ ID NO: 88 - DNA, 20 bp, Artificial Sequence
  Synthetic primer
ctggacggagtagctccaag

SEQ ID NO: 89 - DNA, 20 bp, Artificial Sequence
  Synthetic primer
tcagggggctagaaatctgt

SEQ ID NO: 90 - DNA, 20 bp, Artificial Sequence
  Synthetic primer
gttgggacacagttggtctg

SEQ ID NO: 91 - DNA, 21 bp, Artificial Sequence
  Synthetic primer
ccgaggttaatccagcacgta

SEQ ID NO: 92 - DNA, 22 bp, Artificial Sequence
  Synthetic primer
ctgaagcagatggttcatcatt

SEQ ID NO: 93 - DNA, 25 bp, Artificial Sequence
  Synthetic primer
gaggcaactgcttatggcttaatta

SEQ ID NO: 94 - DNA, 20 bp, Artificial Sequence
  Synthetic primer
tagaatctgctgccagaggg

SEQ ID NO: 95 - DNA, 18 bp, Artificial Sequence
  Synthetic primer
cggtcatcaccaaccagg

SEQ ID NO: 96 - DNA, 18 bp, Artificial Sequence
  Synthetic primer
ccagtggcctcacaggac

SEQ ID NO: 97 - DNA, 20 bp, Artificial Sequence
  Synthetic primer
tcagctgtgagctgcggata

SEQ ID NO: 98 - DNA, 20 bp, Artificial Sequence
  Synthetic primer
cgtgaaggagtgcagaaaga

SEQ ID NO: 99 - DNA, 18 bp, Artificial Sequence
  Synthetic primer
aagccgcatcccagactt

SEQ ID NO: 100 - DNA, 19 bp, Artificial Sequence
  Synthetic primer
atgtctgagtgtgaggcgg

SEQ ID NO: 101 - DNA, 20 bp, Artificial Sequence
  Synthetic primer
ctctctgaaggtgtcctggc

SEQ ID NO: 102 - DNA, 22 bp, Artificial Sequence
  Synthetic primer
caacgtggagtttgatgactct

SEQ ID NO: 103 - DNA, 20 bp, Artificial Sequence
  Synthetic primer
atcctagccctggtttttgg

SEQ ID NO: 104 - DNA, 20 bp, Artificial Sequence
  Synthetic primer
caaacattagctgggcctgt

SEQ ID NO: 105 - DNA, 26 bp, Artificial Sequence
  Synthetic primer
cactaaggtttgagacagttccagaa

SEQ ID NO: 106 - DNA, 22 bp, Artificial Sequence
  Synthetic primer
agaaagcccacatagagaagga

SEQ ID NO: 107 - DNA, 19 bp, Artificial Sequence
  Synthetic primer
acctttctcttggccggat

SEQ ID NO: 108 - DNA, 20 bp, Artificial Sequence
  Synthetic primer
cctcacactggtgaacagga

SEQ ID NO: 109 - DNA, 21 bp, Artificial Sequence
  Synthetic primer
tgagcctgagcagagacatga

SEQ ID NO: 110 - DNA, 22 bp, Artificial Sequence
  Synthetic primer
atccattcgatctcaccaaggt

SEQ ID NO: 111 - DNA, 20 bp, Artificial Sequence
  Synthetic primer
gtggctcaacattgtgttcc

SEQ ID NO: 112 - DNA, 18 bp, Artificial Sequence
  Synthetic primer
cttccctgggacgacttg

SEQ ID NO: 113 - DNA, 19 bp, Artificial Sequence
  Synthetic primer
gctcctgtgcacaagttgg

SEQ ID NO: 114 - DNA, 21 bp, Artificial Sequence
  Synthetic primer
gaacgcatcatccagagactg

SEQ ID NO: 115 - DNA, 23 bp, Artificial Sequence
  Synthetic primer
ccatgtgctgtaccaagagtttg

SEQ ID NO: 116 - DNA, 23 bp, Artificial Sequence
  Synthetic primer
gggtccaggagtacgtgtatgac

SEQ ID NO: 117 - DNA, 20 bp, Artificial Sequence
  Synthetic primer
aggttctgagctctggcttt

SEQ ID NO: 118 - DNA, 20 bp, Artificial Sequence
  Synthetic primer
ttcaggttgttgcaggagac

SEQ ID NO: 119 - DNA, 21 bp, Artificial Sequence
  Synthetic primer
gcatgttcgtggcctctaaga

SEQ ID NO: 120 - DNA, 24 bp, Artificial Sequence
  Synthetic primer
aaagaagatgatgaccgggtttac

SEQ ID NO: 121 - DNA, 25 bp, Artificial Sequence
  Synthetic primer
ggtcaccaagaaacatcagtatgaa

SEQ ID NO: 122 - DNA, 22 bp, Artificial Sequence
  Synthetic primer
atgctgtggctccttcctaact

SEQ ID NO: 123 - DNA, 18 bp, Artificial Sequence
  Synthetic primer
tccaagacccaatgggaa

SEQ ID NO: 124 - DNA, 19 bp, Artificial Sequence
  Synthetic primer
ctcgggaatcctgaaaacc

SEQ ID NO: 125 - DNA, 20 bp, Artificial Sequence
  Synthetic primer
agaccctggtggagctagaa

SEQ ID NO: 126 - DNA, 18 bp, Artificial Sequence
  Synthetic primer
cagactgaatgggggtgg

SEQ ID NO: 127 - DNA, 20 bp, Artificial Sequence
  Synthetic primer
ggatgacatgcactcagctc

SEQ ID NO: 128 - DNA, 24 bp, Artificial Sequence
  Synthetic primer
gcaggtgtcagcaagtatgatcag

SEQ ID NO: 129 - DNA, 19 bp, Artificial Sequence
  Synthetic primer
gtgtgctagcgtactcccg

SEQ ID NO: 130 - DNA, 20 bp, Artificial Sequence
  Synthetic primer
cgtcaggacccaccatgtct

SEQ ID NO: 131 - DNA, 20 bp, Artificial Sequence
  Synthetic primer
ggagtggaaggaactggaaa

SEQ ID NO: 132 - DNA, 21 bp, Artificial Sequence
  Synthetic primer
tccaactaatgccaccaccaa

SEQ ID NO: 133 - DNA, 20 bp, Artificial Sequence
  Synthetic primer
gctgcatgatcagctatggt

SEQ ID NO: 134 - DNA, 25 bp, Artificial Sequence
  Synthetic primer
tgtatttcaagacctctgtgcactt

SEQ ID NO: 135 - DNA, 19 bp, Artificial Sequence
  Synthetic primer
ccactgcacacacctcaga

SEQ ID NO: 136 - DNA, 19 bp, Artificial Sequence
  Synthetic primer
gtaacccaggacgctgagg

SEQ ID NO: 137 - DNA, 20 bp, Artificial Sequence
  Synthetic primer
agatgaagtggaaggcgctt

SEQ ID NO: 138 - DNA, 20 bp, Artificial Sequence
  Synthetic primer
gtgctggagtcgggactaac

SEQ ID NO: 139 - DNA, 20 bp, Artificial Sequence
  Synthetic primer
ggcaccactgcttatgaagg

SEQ ID NO: 140 - DNA, 20 bp, Artificial Sequence
  Synthetic primer
gacgaagacagtccctggat

SEQ ID NO: 141 - DNA, 20 bp, Artificial Sequence
  Synthetic primer
ctcataccagccatccaatg

SEQ ID NO: 142 - DNA, 19 bp, Artificial Sequence
  Synthetic primer
cgacagcatccaccgttac

SEQ ID NO: 143 - DNA, 18 bp, Artificial Sequence
  Synthetic primer
tggttcccagccctgtgt

SEQ ID NO: 144 - DNA, 20 bp, Artificial Sequence
  Synthetic primer
gtgcaggctcaggtgaagtg

SEQ ID NO: 145 - DNA, 20 bp, Artificial Sequence
  Synthetic primer
agggtgaggtgcttgagtct

SEQ ID NO: 146 - DNA, 20 bp, Artificial Sequence
  Synthetic primer
gttcctccggtagcttttca

SEQ ID NO: 147 - DNA, 20 bp, Artificial Sequence
  Synthetic primer
tcttgctggctacgcctctt

SEQ ID NO: 148 - DNA, 21 bp, Artificial Sequence
  Synthetic primer
aaacgagcagtttgccatcag

SEQ ID NO: 149 - DNA, 21 bp, Artificial Sequence
  Synthetic primer
tgagtgtcccccggtatcttc

SEQ ID NO: 150 - DNA, 20 bp, Artificial Sequence
  Synthetic primer
gctacttctccactgtcccg

SEQ ID NO: 151 - DNA, 19 bp, Artificial Sequence
  Synthetic primer
gactgtctgaatggcccag

SEQ ID NO: 152 - DNA, 20 bp, Artificial Sequence
  Synthetic primer
tgaccgataaggatcaaccc

SEQ ID NO: 153 - DNA, 18 bp, Artificial Sequence
  Synthetic primer
acaggagacgtgttcgcc

SEQ ID NO: 154 - DNA, 19 bp, Artificial Sequence
  Synthetic primer
acacaggcgacatacaggc

SEQ ID NO: 155 - DNA, 20 bp, Artificial Sequence
  Synthetic primer
ccttcccatcagcacagttc

SEQ ID NO: 156 - DNA, 18 bp, Artificial Sequence
  Synthetic primer
agtgccctgtctcaccca

SEQ ID NO: 157 - DNA, 18 bp, Artificial Sequence
  Synthetic primer
agcactcacgccctaagc

SEQ ID NO: 158 - DNA, 22 bp, Artificial Sequence
  Synthetic primer
acttgcctgttcagagcactca

SEQ ID NO: 159 - DNA, 21 bp, Artificial Sequence
  Synthetic primer
ttggttttgctcggatacttg

SEQ ID NO: 160 - DNA, 18 bp, Artificial Sequence
  Synthetic primer
ctcccgtcaacagcgttc

SEQ ID NO: 161 - DNA, 21 bp, Artificial Sequence
  Synthetic primer
ggacttttgtccagtgacagc

SEQ ID NO: 162 - DNA, 20 bp, Artificial Sequence
  Synthetic primer
ctgaaggagctccaagacct

SEQ ID NO: 163 - DNA, 26 bp, Artificial Sequence
  Synthetic primer
gataaattggtacaagggatcagctt

SEQ ID NO: 164 - DNA, 21 bp, Artificial Sequence
  Synthetic primer
atgtggaacccccacctactt

SEQ ID NO: 165 - DNA, 18 bp, Artificial Sequence
  Synthetic primer
tgcctgtggtgggaagct

SEQ ID NO: 166 - DNA, 24 bp, Artificial Sequence
  Synthetic primer
ggatatttccgtggctcttattca

SEQ ID NO: 167 - DNA, 19 bp, Artificial Sequence
  Synthetic primer
gtgaccctgaagctgtccc

SEQ ID NO: 168 - DNA, 19 bp, Artificial Sequence
  Synthetic primer
ggtctgtggatgaactgcg

SEQ ID NO: 169 - DNA, 20 bp, Artificial Sequence
  Synthetic primer
ggtctgccctagtcatcctg

SEQ ID NO: 170 - DNA, 23 bp, Artificial Sequence
  Synthetic primer
ccccaggatacctaccactacct

SEQ ID NO: 171 - DNA, 22 bp, Artificial Sequence
  Synthetic primer
gacatttccagtcctgcagtca

SEQ ID NO: 172 - DNA, 21 bp, Artificial Sequence
  Synthetic primer
tccctccactcggaaggacta

SEQ ID NO: 173 - DNA, 18 bp, Artificial Sequence
  Synthetic primer
agctgccatcacgcctac

SEQ ID NO: 174 - DNA, 18 bp, Artificial Sequence
  Synthetic primer
gtggccatccagctgacc

SEQ ID NO: 175 - DNA, 24 bp, Artificial Sequence
  Synthetic primer
cagccaagaactggtataggagct

SEQ ID NO: 176 - DNA, 18 bp, Artificial Sequence
  Synthetic primer
acaaaggcctcccaggat

SEQ ID NO: 177 - DNA, 19 bp, Artificial Sequence
  Synthetic primer
caaccctggtgatgtctgc

SEQ ID NO: 178 - DNA, 18 bp, Artificial Sequence
  Synthetic primer
ggtcgaggaacccaaggt

SEQ ID NO: 179 - DNA, 18 bp, Artificial Sequence
  Synthetic primer
ggtgacaaaggacctcgg

SEQ ID NO: 180 - DNA, 23 bp, Artificial Sequence
  Synthetic primer
tctgcagagttggaagcactcta

SEQ ID NO: 181 - DNA, 21 bp, Artificial Sequence
  Synthetic primer
cgtgagtacacagatgcctcc

SEQ ID NO: 182 - DNA, 20 bp, Artificial Sequence
  Synthetic primer
ggcacatacggattcttgct

SEQ ID NO: 183 - DNA, 18 bp, Artificial Sequence
  Synthetic primer
gatggtgcctccagcaac

SEQ ID NO: 184 - DNA, 18 bp, Artificial Sequence
  Synthetic primer
gggtctgtgccccatgac

SEQ ID NO: 185 - DNA, 19 bp, Artificial Sequence
  Synthetic primer
gacgtgaaccacagggtgt

SEQ ID NO: 186 - DNA, 18 bp, Artificial Sequence
  Synthetic primer
tgcagcggctgattgaca

SEQ ID NO: 187 - DNA, 20 bp, Artificial Sequence
  Synthetic primer
gagcacaaccaaacctacga

SEQ ID NO: 188 - DNA, 24 bp, Artificial Sequence
  Synthetic primer
gaacctgaaggactttctgcttgt

SEQ ID NO: 189 - DNA, 20 bp, Artificial Sequence
  Synthetic primer
taccacacccagcattcctc

SEQ ID NO: 190 - DNA, 19 bp, Artificial Sequence
  Synthetic primer
cccaggcctctgtgtcctt

SEQ ID NO: 191 - DNA, 19 bp, Artificial Sequence
  Synthetic primer
gagttcaagtgccctgacg

SEQ ID NO: 192 - DNA, 20 bp, Artificial Sequence
  Synthetic primer
ggccgagatctacaaaaacg

SEQ ID NO: 193 - DNA, 24 bp, Artificial Sequence
  Synthetic primer
gtacatgatcccctgtgagaaggt

SEQ ID NO: 194 - DNA, 20 bp, Artificial Sequence
  Synthetic primer
gcaagttccaacctggaaag

SEQ ID NO: 195 - DNA, 23 bp, Artificial Sequence
  Synthetic primer
gggaggcttatctcactgagtga

SEQ ID NO: 196 - DNA, 21 bp, Artificial Sequence
  Synthetic primer
tgtctcactgagcgagcagaa

SEQ ID NO: 197 - DNA, 22 bp, Artificial Sequence
  Synthetic primer
tgacaacggctttccagtacat

SEQ ID NO: 198 - DNA, 18 bp, Artificial Sequence
  Synthetic primer
gaggccgttactgtggca

SEQ ID NO: 199 - DNA, 21 bp, Artificial Sequence
  Synthetic primer
atgccctggtaatgtctgcat

SEQ ID NO: 200 - DNA, 21 bp, Artificial Sequence
  Synthetic primer
aagcatcttcctgttcttgga

SEQ ID NO: 201 - DNA, 19 bp, Artificial Sequence
  Synthetic primer
gacccttgccgtctacctg

SEQ ID NO: 202 - DNA, 20 bp, Artificial Sequence
  Synthetic primer
ttcccagttgtgacatgagg

SEQ ID NO: 203 - DNA, 19 bp, Artificial Sequence
  Synthetic primer
ggagcaaaatcgatgcagt

SEQ ID NO: 204 - DNA, 19 bp, Artificial Sequence
  Synthetic primer
gagctacagatgcccatgc

SEQ ID NO: 205 - DNA, 18 bp, Artificial Sequence
  Synthetic primer
tgcgccctttcctctgta

SEQ ID NO: 206 - DNA, 21 bp, Artificial Sequence
  Synthetic primer
accagaccattgtctcagagc

SEQ ID NO: 207 - DNA, 20 bp, Artificial Sequence
  Synthetic primer
tgaccgcttctaccccaatg

SEQ ID NO: 208 - DNA, 19 bp, Artificial Sequence
  Synthetic primer
cagagcctgacggatgtgt

SEQ ID NO: 209 - DNA, 20 bp, Artificial Sequence
  Synthetic primer
ccgtgttcaagaggaagctc

SEQ ID NO: 210 - DNA, 20 bp, Artificial Sequence
  Synthetic primer
gctgtagtgcacgagatcca

SEQ ID NO: 211 - DNA, 30 bp, Artificial Sequence
  Synthetic primer
agaacaaggacaacatagatccttacatat

SEQ ID NO: 212 - DNA, 20 bp, Artificial Sequence
  Synthetic primer
tgctcattcttgaggagcat

SEQ ID NO: 213 - DNA, 18 bp, Artificial Sequence
  Synthetic primer
gtgactgggctcatgcct

SEQ ID NO: 214 - DNA, 22 bp, Artificial Sequence
  Synthetic primer
cgctgacatcatgaatgttcct

SEQ ID NO: 215 - DNA, 20 bp, Artificial Sequence
  Synthetic primer
tcaccagggcaggaagttta

SEQ ID NO: 216 - DNA, 20 bp, Artificial Sequence
  Synthetic primer
aaatgtcctcctcgactgct

SEQ ID NO: 217 - DNA, 21 bp, Artificial Sequence
  Synthetic primer
gaaggccactatcatcctcct

SEQ ID NO: 218 - DNA, 20 bp, Artificial Sequence
  Synthetic primer
ccatagcgtctactgctcca

SEQ ID NO: 219 - DNA, 19 bp, Artificial Sequence
  Synthetic primer
cagagcccagacaccatga

SEQ ID NO: 220 - DNA, 20 bp, Artificial Sequence
  Synthetic primer
gatggcctcaggtggtaact

SEQ ID NO: 221 - DNA, 22 bp, Artificial Sequence
  Synthetic primer
cttgtggagatcacccaatcag

SEQ ID NO: 222 - DNA, 22 bp, Artificial Sequence
  Synthetic primer
gggagaacgggatcaataggat

SEQ ID NO: 223 - DNA, 19 bp, Artificial Sequence
  Synthetic primer
cacaatggcggctctgaag

SEQ ID NO: 224 - DNA, 20 bp, Artificial Sequence
  Synthetic primer
caagcagtcaaggagaacca

SEQ ID NO: 225 - DNA, 20 bp, Artificial Sequence
  Synthetic primer
tccaattccagcatcactgt

SEQ ID NO: 226 - DNA, 20 bp, Artificial Sequence
  Synthetic primer
cagctacactgtcgcagtcc

SEQ ID NO: 227 - DNA, 20 bp, Artificial Sequence
  Synthetic primer
gattcagacgaggatgagcc

SEQ ID NO: 228 - DNA, 21 bp, Artificial Sequence
  Synthetic primer
cacggaggtataaggcaggag

SEQ ID NO: 229 - DNA, 18 bp, Artificial Sequence
  Synthetic primer
ggactccagatgccagga

SEQ ID NO: 230 - DNA, 19 bp, Artificial Sequence
  Synthetic primer
aaagaatggcaccatgcag

SEQ ID NO: 231 - DNA, 21 bp, Artificial Sequence
  Synthetic primer
tgcacagagggtgtgggttac

SEQ ID NO: 232 - DNA, 24 bp, Artificial Sequence
  Synthetic primer
ctctgagacagtgcttcgatgact

SEQ ID NO: 233 - DNA, 20 bp, Artificial Sequence
  Synthetic primer
agacatcagctcctggttca

SEQ ID NO: 234 - DNA, 20 bp, Artificial Sequence
  Synthetic primer
cgtcctaatcaacgtgccta

SEQ ID NO: 235 - DNA, 20 bp, Artificial Sequence
  Synthetic primer
actccctctacccttgagca

SEQ ID NO: 236 - DNA, 22 bp, Artificial Sequence
  Synthetic primer
cgctcctgtttttctcatctgt

SEQ ID NO: 237 - DNA, 18 bp, Artificial Sequence
  Synthetic primer
gctcctgctcctgtgctg

SEQ ID NO: 238 - DNA, 20 bp, Artificial Sequence
  Synthetic primer
acgagtccattgccttcttt

SEQ ID NO: 239 - DNA, 20 bp, Artificial Sequence
  Synthetic primer
tgccacctggacatcatttg

SEQ ID NO: 240 - DNA, 23 bp, Artificial Sequence
  Synthetic primer
cgacaaggagtgcgtctacttct

SEQ ID NO: 241 - DNA, 21 bp, Artificial Sequence
  Synthetic primer
tttcctcaaatttgcctcaag

SEQ ID NO: 242 - DNA, 19 bp, Artificial Sequence
  Synthetic primer
actgtgaactgcctggtgc

SEQ ID NO: 243 - DNA, 21 bp, Artificial Sequence
  Synthetic primer
cgagtggagactggtgttctc

SEQ ID NO: 244 - DNA, 18 bp, Artificial Sequence
  Synthetic primer
ggagcccgtatcctggag

SEQ ID NO: 245 - DNA, 23 bp, Artificial Sequence
  Synthetic primer
tgacattatcatcccgctaagga

SEQ ID NO: 246 - DNA, 22 bp, Artificial Sequence
  Synthetic primer
ctttgccttgctctgtcacagt

SEQ ID NO: 247 - DNA, 20 bp, Artificial Sequence
  Synthetic primer
tgtcgatggacttccagaac

SEQ ID NO: 248 - DNA, 18 bp, Artificial Sequence
  Synthetic primer
gctggtcctctactgcgg

SEQ ID NO: 249 - DNA, 19 bp, Artificial Sequence
  Synthetic primer
gtccccgctgcagatctct

SEQ ID NO: 250 - DNA, 18 bp, Artificial Sequence
  Synthetic primer
ccctcacggactctcagc

SEQ ID NO: 251 - DNA, 19 bp, Artificial Sequence
  Synthetic primer
ggcggtgaagagtcacagt

SEQ ID NO: 252 - DNA, 20 bp, Artificial Sequence
  Synthetic primer
aggtcttgtgcaagaggagc

SEQ ID NO: 253 - DNA, 18 bp, Artificial Sequence
  Synthetic primer
aggcactgagggtggaaa

SEQ ID NO: 254 - DNA, 25 bp, Artificial Sequence
  Synthetic primer
gctagtactttgatgctcccttgat

SEQ ID NO: 255 - DNA, 20 bp, Artificial Sequence
  Synthetic primer
tccttggcttacctgacctc

SEQ ID NO: 256 - DNA, 20 bp, Artificial Sequence
  Synthetic primer
cacctacacggagaacggac

SEQ ID NO: 257 - DNA, 21 bp, Artificial Sequence
  Synthetic primer
ctcctgcgcactaataccttc

SEQ ID NO: 258 - DNA, 21 bp, Artificial Sequence
  Synthetic primer
aagccttggagggtttcattg

SEQ ID NO: 259 - DNA, 20 bp, Artificial Sequence
  Synthetic primer
tcagtgccatacgctctcac

SEQ ID NO: 260 - DNA, 21 bp, Artificial Sequence
  Synthetic primer
cgcctgttcaccaagattgac

SEQ ID NO: 261 - DNA, 18 bp, Artificial Sequence
  Synthetic primer
ccttgggagggaagatcc

SEQ ID NO: 262 - DNA, 18 bp, Artificial Sequence
  Synthetic primer
caaccaggcagctccatc

SEQ ID NO: 263 - DNA, 20 bp, Artificial Sequence
  Synthetic primer
tgaacggggtatcctcctta

SEQ ID NO: 264 - DNA, 20 bp, Artificial Sequence
  Synthetic primer
cagtgccagcaatgacatct

SEQ ID NO: 265 - DNA, 23 bp, Artificial Sequence
  Synthetic primer
cggttatgtcatgccagatacac

SEQ ID NO: 266 - DNA, 25 bp, Artificial Sequence
  Synthetic primer
tggctcttaatcagtttcgttacct

SEQ ID NO: 267 - DNA, 20 bp, Artificial Sequence
  Synthetic primer
gtccaggtggatgtgaaaga

SEQ ID NO: 268 - DNA, 19 bp, Artificial Sequence
  Synthetic primer
ctgctggagtacgagcgac

SEQ ID NO: 269 - DNA, 28 bp, Artificial Sequence
  Synthetic primer
ataacaaagtgtagctctgacatgaatg

SEQ ID NO: 270 - DNA, 18 bp, Artificial Sequence
  Synthetic primer
ccaacactaggctcccca

SEQ ID NO: 271 - DNA, 20 bp, Artificial Sequence
  Synthetic primer
acggatcacagtggaggaag

SEQ ID NO: 272 - DNA, 20 bp, Artificial Sequence
  Synthetic primer
agttcttgacccctggtcct

SEQ ID NO: 273 - DNA, 18 bp, Artificial Sequence
  Synthetic primer
acccccagaccggatcag

SEQ ID NO: 274 - DNA, 20 bp, Artificial Sequence
  Synthetic primer
ccagcaccattgttgaagat

SEQ ID NO: 275 - DNA, 23 bp, Artificial Sequence
  Synthetic primer
gctgcatgtctggaaggtaactg

SEQ ID NO: 276 - DNA, 23 bp, Artificial Sequence
  Synthetic primer
gtgaaggatgtgaagcagacgta

SEQ ID NO: 277 - DNA, 20 bp, Artificial Sequence
  Synthetic primer
gggtccaaagtgatccaaaa

SEQ ID NO: 278 - DNA, 21 bp, Artificial Sequence
  Synthetic primer
ggagacaaagtggtcatcagg

SEQ ID NO: 279 - DNA, 18 bp, Artificial Sequence
  Synthetic primer
ctgaccagaaccacggct

SEQ ID NO: 280 - DNA, 21 bp, Artificial Sequence
  Synthetic primer
ggattgctcaacaaccatgct

SEQ ID NO: 281 - DNA, 24 bp, Artificial Sequence
  Synthetic primer
gcactttgggattctttccattat

SEQ ID NO: 282 - DNA, 20 bp, Artificial Sequence
  Synthetic primer
ccccagtttcaacgagactt

SEQ ID NO: 283 - DNA, 22 bp, Artificial Sequence
  Synthetic primer
tgccatcctgtttctgtatgga

SEQ ID NO: 284 - DNA, 20 bp, Artificial Sequence
  Synthetic primer
gtctccagtggaagggaaaa

SEQ ID NO: 285 - DNA, 24 bp, Artificial Sequence
  Synthetic primer
ggatgattaccttgacctctttgg

SEQ ID NO: 286 - DNA, 19 bp, Artificial Sequence
  Synthetic primer
gtggagaagggtacgccag

SEQ ID NO: 287 - DNA, 18 bp, Artificial Sequence
  Synthetic primer
gacaccgacgggctttta

SEQ ID NO: 288 - DNA, 20 bp, Artificial Sequence
  Synthetic primer
agatgcaggagagaggaagc

SEQ ID NO: 289 - DNA, 20 bp, Artificial Sequence
  Synthetic primer
cacagctgccatacttcgac

SEQ ID NO: 290 - DNA, 20 bp, Artificial Sequence
  Synthetic primer
cacgggacattcaccacatc

SEQ ID NO: 291 - DNA, 19 bp, Artificial Sequence
  Synthetic primer
gagggactgttggcatgca

SEQ ID NO: 292 - DNA, 18 bp, Artificial Sequence
  Synthetic primer
atggttgcagcccaagtc

SEQ ID NO: 293 - DNA, 18 bp, Artificial Sequence
  Synthetic primer
ccagtggagcgcttccat

SEQ ID NO: 294 - DNA, 19 bp, Artificial Sequence
  Synthetic primer
atccagcctttgccgaata

SEQ ID NO: 295 - DNA, 22 bp, Artificial Sequence
  Synthetic primer
ggttccagctttctgtagctgt

SEQ ID NO: 296 - DNA, 19 bp, Artificial Sequence
  Synthetic primer
acaccggtcacaacgtcat

SEQ ID NO: 297 - DNA, 20 bp, Artificial Sequence
  Synthetic primer
ctgccctgactgaatgtgtt

SEQ ID NO: 298 - DNA, 22 bp, Artificial Sequence
  Synthetic primer
ctccttcacacagaacctttca

SEQ ID NO: 299 - DNA, 20 bp, Artificial Sequence
  Synthetic primer
ggctcctgaatctatctttg

SEQ ID NO: 300 - DNA, 18 bp, Artificial Sequence
  Synthetic primer
tgggtccaagatgcaagg

SEQ ID NO: 301 - DNA, 20 bp, Artificial Sequence
  Synthetic primer
accaagaagctgaggacctg

SEQ ID NO: 302 - DNA, 21 bp, Artificial Sequence
  Synthetic primer
ggaagtgacagacgtgaaggt

SEQ ID NO: 303 - DNA, 19 bp, Artificial Sequence
  Synthetic primer
gaacgccaagcaccacaag

SEQ ID NO: 304 - DNA, 21 bp, Artificial Sequence
  Synthetic primer
cgagccctttgatgacttcct

SEQ ID NO: 305 - DNA, 20 bp, Artificial Sequence
  Synthetic primer
agcgctagagactgtggacc

SEQ ID NO: 306 - DNA, 20 bp, Artificial Sequence
  Synthetic primer
ttggtacctgtgggttagca

SEQ ID NO: 307 - DNA, 23 bp, Artificial Sequence
  Synthetic primer
gtaagtcggatgagcctgtctgt

SEQ ID NO: 308 - DNA, 18 bp, Artificial Sequence
  Synthetic primer
tggatcctcacctggtcg

SEQ ID NO: 309 - DNA, 19 bp, Artificial Sequence
  Synthetic primer
tcagcagcaagggcatcat

SEQ ID NO: 310 - DNA, 20 bp, Artificial Sequence
  Synthetic primer
accctcgacaagaccacact

SEQ ID NO: 311 - DNA, 20 bp, Artificial Sequence
  Synthetic primer
aacatgtcatggtccgtgtg

SEQ ID NO: 312 - DNA, 23 bp, Artificial Sequence
  Synthetic primer
caaaggagctcactgtggtgtct

SEQ ID NO: 313 - DNA, 19 bp, Artificial Sequence
  Synthetic primer
gatctcggcttggacgaac

SEQ ID NO: 314 - DNA, 19 bp, Artificial Sequence
  Synthetic primer
gctgtcaatagcaccggaa

SEQ ID NO: 315 - DNA, 19 bp, Artificial Sequence
  Synthetic primer
gcatgggaaccatcaacca

SEQ ID NO: 316 - DNA, 20 bp, Artificial Sequence
  Synthetic primer
ctgttgcaggaaggcattga

SEQ ID NO: 317 - DNA, 30 bp, Artificial Sequence
  Synthetic primer
tgtagaatcaaactcttcatcatcaactag

SEQ ID NO: 318 - DNA, 19 bp, Artificial Sequence
  Synthetic primer
tccgggttaagaacaagcc

SEQ ID NO: 319 - DNA, 19 bp, Artificial Sequence
  Synthetic primer
gttcactgggggtgtatgg

SEQ ID NO: 320 - DNA, 18 bp, Artificial Sequence
  Synthetic primer
taccattgcaaggtgccc

SEQ ID NO: 321 - DNA, 20 bp, Artificial Sequence
  Synthetic primer
gttcgctacgaggattgagc

SEQ ID NO: 322 - DNA, 21 bp, Artificial Sequence
  Synthetic primer
gaacgtgcctgactttgactt

SEQ ID NO: 323 - DNA, 19 bp, Artificial Sequence
  Synthetic primer
tgatgcgcctggaaacagt

SEQ ID NO: 324 - DNA, 18 bp, Artificial Sequence
  Synthetic primer
gcttatgaccgaccccaa

SEQ ID NO: 325 - DNA, 24 bp, Artificial Sequence
  Synthetic primer
cacacagatctcctactccatcca

SEQ ID NO: 326 - DNA, 22 bp, Artificial Sequence
  Synthetic primer
gctctaggtccaattgttctgc

SEQ ID NO: 327 - DNA, 20 bp, Artificial Sequence
  Synthetic primer
tcccactgaagccctttcag

SEQ ID NO: 328 - DNA, 20 bp, Artificial Sequence
  Synthetic primer
ccatctgcatccatcttgtt

SEQ ID NO: 329 - DNA, 23 bp, Artificial Sequence
  Synthetic primer
cgaaaagatgctgaacagtgaca

SEQ ID NO: 330 - DNA, 27 bp, Artificial Sequence
  Synthetic primer
aagctatgaggaaaagaagtacacgat

SEQ ID NO: 331 - DNA, 21 bp, Artificial Sequence
  Synthetic primer
caatgccatcttgcgctacat

SEQ ID NO: 332 - DNA, 20 bp, Artificial Sequence
  Synthetic primer
gagaccctgctgtcccagaa

SEQ ID NO: 333 - DNA, 19 bp, Artificial Sequence
  Synthetic primer
caccatccccaccctgtct

SEQ ID NO: 334 - DNA, 22 bp, Artificial Sequence
  Synthetic primer
gaaagagtttccctatccatgc

SEQ ID NO: 335 - DNA, 20 bp, Artificial Sequence
  Synthetic primer
ccaccagacaagaccgattc

SEQ ID NO: 336 - DNA, 20 bp, Artificial Sequence
  Synthetic primer
ccacccaaggtcacgactac

SEQ ID NO: 337 - DNA, 27 bp, Artificial Sequence
  Synthetic primer
caagtaccacagcgatgactacattaa

SEQ ID NO: 338 - DNA, 20 bp, Artificial Sequence
  Synthetic primer
aggctgctggaggtcatctc

SEQ ID NO: 339 - DNA, 20 bp, Artificial Sequence
  Synthetic primer
cggtgtgagaagtgcagcaa

SEQ ID NO: 340 - DNA, 20 bp, Artificial Sequence
  Synthetic primer
ctcaggtctgcccctacaat

SEQ ID NO: 341 - DNA, 20 bp, Artificial Sequence
  Synthetic primer
ccgaaatccagatgatgatg

SEQ ID NO: 342 - DNA, 20 bp, Artificial Sequence
  Synthetic primer
caggacacaagtgccagatt

SEQ ID NO: 343 - DNA, 24 bp, Artificial Sequence
  Synthetic primer
tgaacataaagtctgcaacatgga

SEQ ID NO: 344 - DNA, 19 bp, Artificial Sequence
  Synthetic primer
tgttggccaggtctcactg

SEQ ID NO: 345 - DNA, 19 bp, Artificial Sequence
  Synthetic primer
aaaaaggcgaagaaggcag

SEQ ID NO: 346 - DNA, 20 bp, Artificial Sequence
  Synthetic primer
cttgtgagggactgagatgc

SEQ ID NO: 347 - DNA, 19 bp, Artificial Sequence
  Synthetic primer
cgccctgaagacagaatgt

SEQ ID NO: 348 - DNA, 21 bp, Artificial Sequence
  Synthetic primer
tccatgatggttctgcaggtt

SEQ ID NO: 349 - DNA, 20 bp, Artificial Sequence
  Synthetic primer
ggtctgctcggtgacagatt

SEQ ID NO: 350 - DNA, 20 bp, Artificial Sequence
  Synthetic primer
catctttcctcctgtggtca

SEQ ID NO: 351 - DNA, 19 bp, Artificial Sequence
  Synthetic primer
tggcctgtccattggtgat

SEQ ID NO: 352 - DNA, 19 bp, Artificial Sequence
  Synthetic primer
agcaggagcgaccaactga

SEQ ID NO: 353 - DNA, 18 bp, Artificial Sequence
  Synthetic primer
caggcagatggacaccaa

SEQ ID NO: 354 - DNA, 19 bp, Artificial Sequence
  Synthetic primer
agctgaagacggccaagat

SEQ ID NO: 355 - DNA, 18 bp, Artificial Sequence
  Synthetic primer
ccaacctgcctcaagagc

SEQ ID NO: 356 - DNA, 20 bp, Artificial Sequence
  Synthetic primer
gcattgtgaccagcacctac

SEQ ID NO: 357 - DNA, 19 bp, Artificial Sequence
  Synthetic primer
ctgctgcgacagtccacta

SEQ ID NO: 358 - DNA, 19 bp, Artificial Sequence
  Synthetic primer
cctccctctggtggtgctt

SEQ ID NO: 359 - DNA, 19 bp, Artificial Sequence
  Synthetic primer
ccgactggaggagcataaa

SEQ ID NO: 360 - DNA, 20 bp, Artificial Sequence
  Synthetic primer
gagtacgtgtgccgagtgtt

SEQ ID NO: 361 - DNA, 19 bp, Artificial Sequence
  Synthetic primer
tcgaattgtttgggcactg

SEQ ID NO: 362 - DNA, 20 bp, Artificial Sequence
  Synthetic primer
tggctgtggagttcaaatgt

SEQ ID NO: 363 - DNA, 19 bp, Artificial Sequence
  Synthetic primer
caaccatgcactcccagtc

SEQ ID NO: 364 - DNA, 19 bp, Artificial Sequence
  Synthetic primer
tatgtccgcctcacacacc

SEQ ID NO: 365 - DNA, 24 bp, Artificial Sequence
  Synthetic primer
gcagacagtgaccatctacagctt

SEQ ID NO: 366 - DNA, 20 bp, Artificial Sequence
  Synthetic primer
ggtcatcctgacactgcaac

SEQ ID NO: 367 - DNA, 19 bp, Artificial Sequence
  Synthetic primer
gccttcaatctcagcaacg

SEQ ID NO: 368 - DNA, 19 bp, Artificial Sequence
  Synthetic primer
agaaccgcaaggtgagcaa

SEQ ID NO: 369 - DNA, 23 bp, Artificial Sequence
  Synthetic primer
aacgactgctactccaagctcaa

SEQ ID NO: 370 - DNA, 20 bp, Artificial Sequence
  Synthetic primer
cttcaccaaatcccttcctg

SEQ ID NO: 371 - DNA, 20 bp, Artificial Sequence
  Synthetic primer
ctctccggattgaccaagtt

SEQ ID NO: 372 - DNA, 21 bp, Artificial Sequence
  Synthetic primer
tccggagctgtgatctaagga

SEQ ID NO: 373 - DNA, 21 bp, Artificial Sequence
  Synthetic primer
gcatggtagccgaagatttca

SEQ ID NO: 374 - DNA, 19 bp, Artificial Sequence
  Synthetic primer
ccgtgcttccggacaactt

SEQ ID NO: 375 - DNA, 19 bp, Artificial Sequence
  Synthetic primer
gtggacagcaccatgaaca

SEQ ID NO: 376 - DNA, 18 bp, Artificial Sequence
  Synthetic primer
acatcccaacgcatgctc

SEQ ID NO: 377 - DNA, 22 bp, Artificial Sequence
  Synthetic primer
tggacaagtacgggatgaagct

SEQ ID NO: 378 - DNA, 20 bp, Artificial Sequence
  Synthetic primer
tgaaccgcagagaccaacag

SEQ ID NO: 379 - DNA, 19 bp, Artificial Sequence
  Synthetic primer
gcggtgattcggaaattcg

SEQ ID NO: 380 - DNA, 26 bp, Artificial Sequence
  Synthetic primer
aaggaaccatctcactgtgtgtaaac

SEQ ID NO: 381 - DNA, 20 bp, Artificial Sequence
  Synthetic primer
ggcgctgtcatcgatttctt

SEQ ID NO: 382 - DNA, 20 bp, Artificial Sequence
  Synthetic primer
tggaaggttccacaagtcac

SEQ ID NO: 383 - DNA, 18 bp, Artificial Sequence
  Synthetic primer
ggctgggtaccaatgctg

SEQ ID NO: 384 - DNA, 20 bp, Artificial Sequence
  Synthetic primer
agctgaggaagatgctggtt

SEQ ID NO: 385 - DNA, 20 bp, Artificial Sequence
  Synthetic primer
cctgaaccttccaaagatgg

SEQ ID NO: 386 - DNA, 20 bp, Artificial Sequence
  Synthetic primer
ggcctaatgttccagatcct

SEQ ID NO: 387 - DNA, 20 bp, Artificial Sequence
  Synthetic primer
agccatcactctcagtgcag

SEQ ID NO: 388 - DNA, 20 bp, Artificial Sequence
  Synthetic primer
gtggactcgtccaagatcaa

SEQ ID NO: 389 - DNA, 19 bp, Artificial Sequence
  Synthetic primer
cgccttgcacgtctagttc

SEQ ID NO: 390 - DNA, 19 bp, Artificial Sequence
  Synthetic primer
gtgcccgagccatatagca

SEQ ID NO: 391 - DNA, 20 bp, Artificial Sequence
  Synthetic primer
agcctccaggataccagcaa

SEQ ID NO: 392 - DNA, 19 bp, Artificial Sequence
  Synthetic primer
cagtctccgagagcggatt

SEQ ID NO: 393 - DNA, 19 bp, Artificial Sequence
  Synthetic primer
agagacaccagcaactgcg

SEQ ID NO: 394 - DNA, 20 bp, Artificial Sequence
  Synthetic primer
gtgtcagactgaagccccat

SEQ ID NO: 395 - DNA, 20 bp, Artificial Sequence
  Synthetic primer
ccatgatcctcactctgctg

SEQ ID NO: 396 - DNA, 21 bp, Artificial Sequence
  Synthetic primer
caacgcttcagtgatcaatcc

SEQ ID NO: 397 - DNA, 20 bp, Artificial Sequence
  Synthetic primer
aggccagccctacattatca

SEQ ID NO: 398 - DNA, 20 bp, Artificial Sequence
  Synthetic primer
cagtgacaaacagcccttcc

SEQ ID NO: 399 - DNA, 22 bp, Artificial Sequence
  Synthetic primer
gatatgattggtcgctgctttg

SEQ ID NO: 400 - DNA, 21 bp, Artificial Sequence
  Synthetic primer
actcggactgcacaagctatt

SEQ ID NO: 401 - DNA, 20 bp, Artificial Sequence
  Synthetic primer
tcagaattggatttggctca

SEQ ID NO: 402 - DNA, 19 bp, Artificial Sequence
  Synthetic primer
accggggagccctacatga

SEQ ID NO: 403 - DNA, 18 bp, Artificial Sequence
  Synthetic primer
caaggtgccctcagtgga

SEQ ID NO: 404 - DNA, 20 bp, Artificial Sequence
  Synthetic primer
tcgtgaaagatgaccaggag

SEQ ID NO: 405 - DNA, 19 bp, Artificial Sequence
  Synthetic primer
tggcttacactggcaatgg

SEQ ID NO: 406 - DNA, 20 bp, Artificial Sequence
  Synthetic primer
gtcaaaatggggagggacta

SEQ ID NO: 407 - DNA, 20 bp, Artificial Sequence
  Synthetic primer
ggacgttctacctgccttga

SEQ ID NO: 408 - DNA, 20 bp, Artificial Sequence
  Synthetic primer
gaggacgaaggcctctacac

SEQ ID NO: 409 - DNA, 19 bp, Artificial Sequence
  Synthetic primer
cggactttgggtgcgactt

SEQ ID NO: 410 - DNA, 19 bp, Artificial Sequence
  Synthetic primer
actacagcgggagcaggag

SEQ ID NO: 411 - DNA, 19 bp, Artificial Sequence
  Synthetic primer
ctcctactggtcgcacacc

SEQ ID NO: 412 - DNA, 18 bp, Artificial Sequence
  Synthetic primer
gtccccgggatggatgtt

SEQ ID NO: 413 - DNA, 22 bp, Artificial Sequence
  Synthetic primer
gaggtcctgtctaaaccctgtg

SEQ ID NO: 414 - DNA, 19 bp, Artificial Sequence
  Synthetic primer
ccaagcttaccacctgcac

SEQ ID NO: 415 - DNA, 20 bp, Artificial Sequence
  Synthetic primer
tgagagccaggcttcttgta

SEQ ID NO: 416 - DNA, 21 bp, Artificial Sequence
  Synthetic primer
tgagcggcagaatcaggagta

SEQ ID NO: 417 - DNA, 20 bp, Artificial Sequence
  Synthetic primer
tcagtggagaaggagttgga

SEQ ID NO: 418 - DNA, 18 bp, Artificial Sequence
  Synthetic primer
ttcagagatgaaccgggc

SEQ ID NO: 419 - DNA, 18 bp, Artificial Sequence
  Synthetic primer
cttgctggccaatgccta

SEQ ID NO: 420 - DNA, 20 bp, Artificial Sequence
  Synthetic primer
cagatgaggcacatggagac

SEQ ID NO: 421 - DNA, 19 bp, Artificial Sequence
  Synthetic primer
gatgcactgcggttagcag

SEQ ID NO: 422 - DNA, 20 bp, Artificial Sequence
  Synthetic primer
caaggagactgggaggtgtc

SEQ ID NO: 423 - DNA, 20 bp, Artificial Sequence
  Synthetic primer
actgaccaagcctgagacct

SEQ ID NO: 424 - DNA, 21 bp, Artificial Sequence
  Synthetic primer
actcaagcggaaattgaagca

SEQ ID NO: 425 - DNA, 19 bp, Artificial Sequence
  Synthetic primer
tgctggacttctgcctgag

SEQ ID NO: 426 - DNA, 19 bp, Artificial Sequence
  Synthetic primer
aacacccagtttgacgcag

SEQ ID NO: 427 - DNA, 18 bp, Artificial Sequence
  Synthetic primer
atcacggtggactgcgac

SEQ ID NO: 428 - DNA, 20 bp, Artificial Sequence
  Synthetic primer
aggctacacatcctgggcta

SEQ ID NO: 429 - DNA, 20 bp, Artificial Sequence
  Synthetic primer
gggtggagtcttctgacagc

SEQ ID NO: 430 - DNA, 20 bp, Artificial Sequence
  Synthetic primer
agcggaaaatggcagacaat

SEQ ID NO: 431 - DNA, 18 bp, Artificial Sequence
  Synthetic primer
agtacttccaccgcgtgc

SEQ ID NO: 432 - DNA, 20 bp, Artificial Sequence
  Synthetic primer
gcttcaggtgttgtgactgc

SEQ ID NO: 433 - DNA, 19 bp, Artificial Sequence
  Synthetic primer
tgcaaacgctggtgtcaca

SEQ ID NO: 434 - DNA, 18 bp, Artificial Sequence
  Synthetic primer
ggctgccagcagaacatc

SEQ ID NO: 435 - DNA, 18 bp, Artificial Sequence
  Synthetic primer
ccaatgggagaacaacgg

SEQ ID NO: 436 - DNA, 20 bp, Artificial Sequence
  Synthetic primer
ggctgtagactgggtttcca

SEQ ID NO: 437 - DNA, 20 bp, Artificial Sequence
  Synthetic primer
ccagtgtcccaatctgtgtc

SEQ ID NO: 438 - DNA, 19 bp, Artificial Sequence
  Synthetic primer
aacggaagcctgtgactga

SEQ ID NO: 439 - DNA, 20 bp, Artificial Sequence
  Synthetic primer
ttgctgcaagataacatcgc

SEQ ID NO: 440 - DNA, 23 bp, Artificial Sequence
  Synthetic primer
gctgcctttggtaagaacatgtc

SEQ ID NO: 441 - DNA, 22 bp, Artificial Sequence
  Synthetic primer
ggacattactggcctgttcaca

SEQ ID NO: 442 - DNA, 19 bp, Artificial Sequence
  Synthetic primer
gttgggagcttgctgtgtc

SEQ ID NO: 443 - DNA, 19 bp, Artificial Sequence
  Synthetic primer
ccttcgtctgcctggagat

SEQ ID NO: 444 - DNA, 23 bp, Artificial Sequence
  Synthetic primer
gcctttcttacccagaagcagaa

SEQ ID NO: 445 - DNA, 20 bp, Artificial Sequence
  Synthetic primer
gccctccaatgtccttatca

SEQ ID NO: 446 - DNA, 18 bp, Artificial Sequence
  Synthetic primer
gccggtcaggcacacaag

SEQ ID NO: 447 - DNA, 20 bp, Artificial Sequence
  Synthetic primer
cccctcttggatctgttgag

SEQ ID NO: 448 - DNA, 23 bp, Artificial Sequence
  Synthetic primer
cagatggccactttgagaacatt

SEQ ID NO: 449 - DNA, 19 bp, Artificial Sequence
  Synthetic primer
cgagttccagtggctgaga

SEQ ID NO: 450 - DNA, 21 bp, Artificial Sequence
  Synthetic primer
gacttttgcccgctacctttc

SEQ ID NO: 451 - DNA, 20 bp, Artificial Sequence
  Synthetic primer
ggagaacaatccccttgaga

SEQ ID NO: 452 - DNA, 24 bp, Artificial Sequence
  Synthetic primer
tgatggtcctatgtgtcacattca

SEQ ID NO: 453 - DNA, 19 bp, Artificial Sequence
  Synthetic primer
cgctcagccagatgcaatc

SEQ ID NO: 454 - DNA, 20 bp, Artificial Sequence
  Synthetic primer
ccaacacctttgttgcagag

SEQ ID NO: 455 - DNA, 19 bp, Artificial Sequence
  Synthetic primer
ggagccgactgcaagtaca

SEQ ID NO: 456 - DNA, 19 bp, Artificial Sequence
  Synthetic primer
ctacagggacgccatcgaa

SEQ ID NO: 457 - DNA, 20 bp, Artificial Sequence
  Synthetic primer
gtgaaatgaaacgcaccaca

SEQ ID NO: 458 - DNA, 21 bp, Artificial Sequence
  Synthetic primer
acggatctaccacaccattgc

SEQ ID NO: 459 - DNA, 18 bp, Artificial Sequence
  Synthetic primer
atggtgaatgtcacccgc

SEQ ID NO: 460 - DNA, 19 bp, Artificial Sequence
  Synthetic primer
ccggacagggtctacatca

SEQ ID NO: 461 - DNA, 21 bp, Artificial Sequence
  Synthetic primer
gggagatcatcgggacaactc

SEQ ID NO: 462 - DNA, 26 bp, Artificial Sequence
  Synthetic primer
tgtacccactctacaactcattcaca

SEQ ID NO: 463 - DNA, 19 bp, Artificial Sequence
  Synthetic primer
gctgtggagctctcaggaa

SEQ ID NO: 464 - DNA, 20 bp, Artificial Sequence
  Synthetic primer
ccatgatggagaggcagaca

SEQ ID NO: 465 - DNA, 26 bp, Artificial Sequence
  Synthetic primer
ggatggtagcagtctagggattaact

SEQ ID NO: 466 - DNA, 20 bp, Artificial Sequence
  Synthetic primer
gagaaccaatctcaccgaca

SEQ ID NO: 467 - DNA, 18 bp, Artificial Sequence
  Synthetic primer
tcatggtgcccgtcaatg

SEQ ID NO: 468 - DNA, 20 bp, Artificial Sequence
  Synthetic primer
aggggatgacttggacacat

SEQ ID NO: 469 - DNA, 22 bp, Artificial Sequence
  Synthetic primer
tcatcctggcgatctacttcct

SEQ ID NO: 470 - DNA, 20 bp, Artificial Sequence
  Synthetic primer
agcgcctggaatctacaact

SEQ ID NO: 471 - DNA, 20 bp, Artificial Sequence
  Synthetic primer
gatgcagaattgaggcagac

SEQ ID NO: 472 - DNA, 21 bp, Artificial Sequence
  Synthetic primer
tgattaccatcatggctcaga

SEQ ID NO: 473 - DNA, 20 bp, Artificial Sequence
  Synthetic primer
tctattgggggattggtagg

SEQ ID NO: 474 - DNA, 18 bp, Artificial Sequence
  Synthetic primer
gtgggctgtgccaagtgt

SEQ ID NO: 475 - DNA, 18 bp, Artificial Sequence
  Synthetic primer
gtgcacccactgcctctt

SEQ ID NO: 476 - DNA, 19 bp, Artificial Sequence
  Synthetic primer
cgtgttccactgcctcttc

SEQ ID NO: 477 - DNA, 21 bp, Artificial Sequence
  Synthetic primer
ctcctgcaaatgcaaagagtg

SEQ ID NO: 478 - DNA, 20 bp, Artificial Sequence
  Synthetic primer
ggccaggatctgtggtggta

SEQ ID NO: 479 - DNA, 22 bp, Artificial Sequence
  Synthetic primer
acgagaacgagggcatctatgt

SEQ ID NO: 480 - DNA, 23 bp, Artificial Sequence
  Synthetic primer
gaaggaatgggaatcagtcatga

SEQ ID NO: 481 - DNA, 18 bp, Artificial Sequence
  Synthetic primer
gccgagatcgccaagatg

SEQ ID NO: 482 - DNA, 27 bp, Artificial Sequence
  Synthetic primer
cggtacttctcagggctaatatatacg

SEQ ID NO: 483 - DNA, 20 bp, Artificial Sequence
  Synthetic primer
ccttcaccttcctcgtcaac

SEQ ID NO: 484 - DNA, 21 bp, Artificial Sequence
  Synthetic primer
gcatctacttgccagaaccaa

SEQ ID NO: 485 - DNA, 20 bp, Artificial Sequence
  Synthetic primer
gacaccttcatccgtcacat

SEQ ID NO: 486 - DNA, 19 bp, Artificial Sequence
  Synthetic primer
ctgaacccctctcctggtc

SEQ ID NO: 487 - DNA, 21 bp, Artificial Sequence
  Synthetic primer
cagtcaaggtcagaggctgag

SEQ ID NO: 488 - DNA, 20 bp, Artificial Sequence
  Synthetic primer
cagaccaaggagatggacct

SEQ ID NO: 489 - DNA, 19 bp, Artificial Sequence
  Synthetic primer
ctgccgggatggcttctat

SEQ ID NO: 490 - DNA, 18 bp, Artificial Sequence
  Synthetic primer
ccctgccataccagctca

SEQ ID NO: 491 - DNA, 19 bp, Artificial Sequence
  Synthetic primer
atgcttggggagaccaatc

SEQ ID NO: 492 - DNA, 18 bp, Artificial Sequence
  Synthetic primer
cctagggcagggatggag

SEQ ID NO: 493 - DNA, 20 bp, Artificial Sequence
  Synthetic primer
cagccttgggaagtgagact

SEQ ID NO: 494 - DNA, 20 bp, Artificial Sequence
  Synthetic primer
gggtccattatgactcccaa

SEQ ID NO: 495 - DNA, 18 bp, Artificial Sequence
  Synthetic primer
atctccgcctcgctcatg

SEQ ID NO: 496 - DNA, 20 bp, Artificial Sequence
  Synthetic primer
cgggtccaccagtttgaatg

SEQ ID NO: 497 - DNA, 20 bp, Artificial Sequence
  Synthetic primer
cacttccctgctgggattat

SEQ ID NO: 498 - DNA, 18 bp, Artificial Sequence
  Synthetic primer
tgtggacgagtgtgctgg

SEQ ID NO: 499 - DNA, 20 bp, Artificial Sequence
  Synthetic primer
ggctgtggctgaggctgtag

SEQ ID NO: 500 - DNA, 22 bp, Artificial Sequence
  Synthetic primer
aatgttgtccaggttctattgc

SEQ ID NO: 501 - DNA, 21 bp, Artificial Sequence
  Synthetic primer
gacacctgcttctgattccac

SEQ ID NO: 502 - DNA, 18 bp, Artificial Sequence
  Synthetic primer
acatctgcagctcccctg

SEQ ID NO: 503 - DNA, 19 bp, Artificial Sequence
  Synthetic primer
ggatcttccccactctgct

SEQ ID NO: 504 - DNA, 27 bp, Artificial Sequence
  Synthetic primer
cgagactctcctcatagtgaaaggtat

SEQ ID NO: 505 - DNA, 20 bp, Artificial Sequence
  Synthetic primer
actggtttccactcctgctt

SEQ ID NO: 506 - DNA, 18 bp, Artificial Sequence
  Synthetic primer
accaaggtggctgactgc

SEQ ID NO: 507 - DNA, 23 bp, Artificial Sequence
  Synthetic primer
caaccgaagttttcactccagtt

SEQ ID NO: 508 - DNA, 21 bp, Artificial Sequence
  Synthetic primer
tggagactctcagggtcgaaa

SEQ ID NO: 509 - DNA, 21 bp, Artificial Sequence
  Synthetic primer
cggtggaccacgaagagttaa

SEQ ID NO: 510 - DNA, 20 bp, Artificial Sequence
  Synthetic primer
ctttgaacccttgcttgcaa

SEQ ID NO: 511 - DNA, 22 bp, Artificial Sequence
  Synthetic primer
tggctgattccattaacagtga

SEQ ID NO: 512 - DNA, 19 bp, Artificial Sequence
  Synthetic primer
ccgcaacgtggttttctca

SEQ ID NO: 513 - DNA, 20 bp, Artificial Sequence
  Synthetic primer
gagctgtgggttgttatgga

SEQ ID NO: 514 - DNA, 19 bp, Artificial Sequence
  Synthetic primer
gatcctcgaggtcaatggc

SEQ ID NO: 515 - DNA, 20 bp, Artificial Sequence
  Synthetic primer
gcaaagcctttccagaaaaa

SEQ ID NO: 516 - DNA, 21 bp, Artificial Sequence
  Synthetic primer
ggtgaaatctgtgcactgtca

SEQ ID NO: 517 - DNA, 18 bp, Artificial Sequence
  Synthetic primer
cttagcatggcccagcac

SEQ ID NO: 518 - DNA, 22 bp, Artificial Sequence
  Synthetic primer
gaaggtgttggaggcactcaag

SEQ ID NO: 519 - DNA, 20 bp, Artificial Sequence
  Synthetic primer
accttgagtagcagaggccc

SEQ ID NO: 520 - DNA, 18 bp, Artificial Sequence
  Synthetic primer
gacaacgccaccttcacc

SEQ ID NO: 521 - DNA, 20 bp, Artificial Sequence
  Synthetic primer
gcttcgtcttgctgtgagag

SEQ ID NO: 522 - DNA, 19 bp, Artificial Sequence
  Synthetic primer
ttgttggtgtgccctggtg

SEQ ID NO: 523 - DNA, 20 bp, Artificial Sequence
  Synthetic primer
actgaaggagacccttggag

SEQ ID NO: 524 - DNA, 28 bp, Artificial Sequence
  Synthetic primer
agttactaaaaaataccacgaggtcctt

SEQ ID NO: 525 - DNA, 20 bp, Artificial Sequence
  Synthetic primer
tatcgaggcaggtcatacca

SEQ ID NO: 526 - DNA, 20 bp, Artificial Sequence
  Synthetic primer
gggagtttccaagagatgga

SEQ ID NO: 527 - DNA, 20 bp, Artificial Sequence
  Synthetic primer
ccagctctccttccagctac

SEQ ID NO: 528 - DNA, 20 bp, Artificial Sequence
  Synthetic primer
aatgacctccaccttcaacc

SEQ ID NO: 529 - DNA, 20 bp, Artificial Sequence
  Synthetic primer
gagctgagagccttgagcat

SEQ ID NO: 530 - DNA, 19 bp, Artificial Sequence
  Synthetic primer
gcagtgcctgtgtgtgaag

SEQ ID NO: 531 - DNA, 19 bp, Artificial Sequence
  Synthetic primer
agctgatgccgcatacatt

SEQ ID NO: 532 - DNA, 22 bp, Artificial Sequence
  Synthetic primer
tctatacgtcgatggtgactgc

SEQ ID NO: 533 - DNA, 18 bp, Artificial Sequence
  Synthetic primer
gtggttttccctcggagc

SEQ ID NO: 534 - DNA, 18 bp, Artificial Sequence
  Synthetic primer
tgctacctggacagcccg

SEQ ID NO: 535 - DNA, 21 bp, Artificial Sequence
  Synthetic primer
ataccaatcaccgcacaaacc

SEQ ID NO: 536 - DNA, 20 bp, Artificial Sequence
  Synthetic primer
gtgattgaagagcatgccaa

SEQ ID NO: 537 - DNA, 21 bp, Artificial Sequence
  Synthetic primer
ccctttccccaagtagaagag

SEQ ID NO: 538 - DNA, 20 bp, Artificial Sequence
  Synthetic primer
gatttgctgggaagtgctgt

SEQ ID NO: 539 - DNA, 20 bp, Artificial Sequence
  Synthetic primer
cccatggatgctcctctgaa

SEQ ID NO: 540 - DNA, 20 bp, Artificial Sequence
  Synthetic primer
ggcaaaatttccaagaccat

SEQ ID NO: 541 - DNA, 22 bp, Artificial Sequence
  Synthetic primer
tgatgcttctctgaagttctgc

SEQ ID NO: 542 - DNA, 19 bp, Artificial Sequence
  Synthetic primer
cagggaggtggttgcaaat

SEQ ID NO: 543 - DNA, 20 bp, Artificial Sequence
  Synthetic primer
agaacagactggcctgagga

SEQ ID NO: 544 - DNA, 19 bp, Artificial Sequence
  Synthetic primer
ccatctacacggtgaggca

SEQ ID NO: 545 - DNA, 19 bp, Artificial Sequence
  Synthetic primer
acaagcaccatcccagtga

SEQ ID NO: 546 - DNA, 21 bp, Artificial Sequence
  Synthetic primer
tgactttatggagcccaagtt

SEQ ID NO: 547 - DNA, 20 bp, Artificial Sequence
  Synthetic primer
ttccttccctctcaatccac

SEQ ID NO: 548 - DNA, 20 bp, Artificial Sequence
  Synthetic primer
gcaatcatggaacttgacga

SEQ ID NO: 549 - DNA, 18 bp, Artificial Sequence
  Synthetic primer
gaggaagaggaggcggtg

SEQ ID NO: 550 - DNA, 21 bp, Artificial Sequence
  Synthetic primer
caagcaatgcgtcatcaatgt

SEQ ID NO: 551 - DNA, 18 bp, Artificial Sequence
  Synthetic primer
gacccagctccactcctg

SEQ ID NO: 552 - DNA, 20 bp, Artificial Sequence
  Synthetic primer
ctgacacttgccgcagagaa

SEQ ID NO: 553 - DNA, 21 bp, Artificial Sequence
  Synthetic primer
ctccacctatgagcgtctgtc

SEQ ID NO: 554 - DNA, 20 bp, Artificial Sequence
  Synthetic primer
attggaaaaacctcgtcacc

SEQ ID NO: 555 - DNA, 19 bp, Artificial Sequence
  Synthetic primer
ctatgacaggcatgccacc

SEQ ID NO: 556 - DNA, 19 bp, Artificial Sequence
  Synthetic primer
cttcagcgcatccactacc

SEQ ID NO: 557 - DNA, 20 bp, Artificial Sequence
  Synthetic primer
cactgcaccaagattcaggt

SEQ ID NO: 558 - DNA, 21 bp, Artificial Sequence
  Synthetic primer
gtacactctggcctccagcta

SEQ ID NO: 559 - DNA, 20 bp, Artificial Sequence
  Synthetic primer
gccaaactgcaggatgaaag

SEQ ID NO: 560 - DNA, 20 bp, Artificial Sequence
  Synthetic primer
cagtggctatcggcctaatc

SEQ ID NO: 561 - DNA, 20 bp, Artificial Sequence
  Synthetic primer
ggggtgtcatctacctggtc

SEQ ID NO: 562 - DNA, 25 bp, Artificial Sequence
  Synthetic primer
tggctaagtgaagatgacaatcatg

SEQ ID NO: 563 - DNA, 18 bp, Artificial Sequence
  Synthetic primer
ccacactggcatctccct

SEQ ID NO: 564 - DNA, 24 bp, Artificial Sequence
  Synthetic primer
cgaggtacaagctgagatcaagaa

SEQ ID NO: 565 - DNA, 20 bp, Artificial Sequence
  Synthetic primer
gaccggtcgaatgataaggt

SEQ ID NO: 566 - DNA, 19 bp, Artificial Sequence
  Synthetic primer
caagcccagccgacctaag

SEQ ID NO: 567 - DNA, 20 bp, Artificial Sequence
  Synthetic primer
ccttccagtccaaaaatccc

SEQ ID NO: 568 - DNA, 24 bp, Artificial Sequence
  Synthetic primer
ctccagctagcactaagcaacatc

SEQ ID NO: 569 - DNA, 20 bp, Artificial Sequence
  Synthetic primer
gatatgcggtgaggaacagc

SEQ ID NO: 570 - DNA, 18 bp, Artificial Sequence
  Synthetic primer
tggccgtcaatggaagag

SEQ ID NO: 571 - DNA, 20 bp, Artificial Sequence
  Synthetic primer
ggacagcgacaaagacttga

SEQ ID NO: 572 - DNA, 28 bp, Artificial Sequence
  Synthetic primer
ggctactctgatctatgttgataaggaa

SEQ ID NO: 573 - DNA, 20 bp, Artificial Sequence
  Synthetic primer
aaaccaagatgctgatggct

SEQ ID NO: 574 - DNA, 18 bp, Artificial Sequence
  Synthetic primer
gctgctcaagctgaaccc

SEQ ID NO: 575 - DNA, 21 bp, Artificial Sequence
  Synthetic primer
tgttgtaaatgtctcagcccc

SEQ ID NO: 576 - DNA, 20 bp, Artificial Sequence
  Synthetic primer
agactactcgggtcgaggtg

SEQ ID NO: 577 - DNA, 20 bp, Artificial Sequence
  Synthetic primer
cgtcgtatgcgagagtctgt

SEQ ID NO: 578 - DNA, 26 bp, Artificial Sequence
  Synthetic primer
ggtgtcagatataaatgtgcaaatgc

SEQ ID NO: 579 - DNA, 20 bp, Artificial Sequence
  Synthetic primer
tgcctggacatcctgattct

SEQ ID NO: 580 - DNA, 19 bp, Artificial Sequence
  Synthetic primer
agggcacgtgaagtcattg

SEQ ID NO: 581 - DNA, 20 bp, Artificial Sequence
  Synthetic primer
cgaagcccttacaagtttcc

SEQ ID NO: 582 - DNA, 19 bp, Artificial Sequence
  Synthetic primer
tggttttgaatcaccaggg

SEQ ID NO: 583 - DNA, 19 bp, Artificial Sequence
  Synthetic primer
tgctaactcctgcacagcc

SEQ ID NO: 584 - DNA, 19 bp, Artificial Sequence
  Synthetic primer
gcctgtgcagttcttgtgc

SEQ ID NO: 585 - DNA, 22 bp, Artificial Sequence
  Synthetic primer
tgccctgtaaagcagaagagat

SEQ ID NO: 586 - DNA, 23 bp, Artificial Sequence
  Synthetic primer
ttcaaacggaggctcctaaagag

SEQ ID NO: 587 - DNA, 21 bp, Artificial Sequence
  Synthetic primer
gatgattgagaacagccttgc

SEQ ID NO: 588 - DNA, 21 bp, Artificial Sequence
  Synthetic primer
aagcatgaacaggacttgacc

SEQ ID NO: 589 - DNA, 18 bp, Artificial Sequence
  Synthetic primer
cccgttcggtctgaggaa

SEQ ID NO: 590 - DNA, 20 bp, Artificial Sequence
  Synthetic primer
agtaccttcaagccggtcaa

SEQ ID NO: 591 - DNA, 19 bp, Artificial Sequence
  Synthetic primer
tcggaattggacttgggag

SEQ ID NO: 592 - DNA, 22 bp, Artificial Sequence
  Synthetic primer
tgtgcacataggaatgagcttc

SEQ ID NO: 593 - DNA, 18 bp, Artificial Sequence
  Synthetic primer
gatccgagaccctcgctc

SEQ ID NO: 594 - DNA, 18 bp, Artificial Sequence
  Synthetic primer
caaggtgctcggtccttc

SEQ ID NO: 595 - DNA, 20 bp, Artificial Sequence
  Synthetic primer
gttctggttgctggatttgg

SEQ ID NO: 596 - DNA, 20 bp, Artificial Sequence
  Synthetic primer
cttacggggaagaccatcac

SEQ ID NO: 597 - DNA, 20 bp, Artificial Sequence
  Synthetic primer
gctcatggagctagtgcctc

SEQ ID NO: 598 - DNA, 25 bp, Artificial Sequence
  Synthetic primer
gctcattatgaaaaacatcccaaac

SEQ ID NO: 599 - DNA, 20 bp, Artificial Sequence
  Synthetic primer
gggctactggcagctacatt

SEQ ID NO: 600 - DNA, 20 bp, Artificial Sequence
  Synthetic primer
cagcgggattaaacagtcct

SEQ ID NO: 601 - DNA, 20 bp, Artificial Sequence
  Synthetic primer
aacagagacattgccaacca

SEQ ID NO: 602 - DNA, 20 bp, Artificial Sequence
  Synthetic primer
tggacaaggtgatgaaggag

SEQ ID NO: 603 - DNA, 20 bp, Artificial Sequence
  Synthetic primer
acaccaaaatgccatctcaa

SEQ ID NO: 604 - DNA, 21 bp, Artificial Sequence
  Synthetic primer
tggctgtgctggtcactacct

SEQ ID NO: 605 - DNA, 21 bp, Artificial Sequence
  Synthetic primer
ctacagcacagatcagcacca

SEQ ID NO: 606 - DNA, 18 bp, Artificial Sequence
  Synthetic primer
gccttcctggagtacccg

SEQ ID NO: 607 - DNA, 20 bp, Artificial Sequence
  Synthetic primer
atcaacatcctgtcgaggct

SEQ ID NO: 608 - DNA, 22 bp, Artificial Sequence
  Synthetic primer
gcagaactgaagatgggaagat

SEQ ID NO: 609 - DNA, 19 bp, Artificial Sequence
  Synthetic primer
accagcacaagatggagca

SEQ ID NO: 610 - DNA, 20 bp, Artificial Sequence
  Synthetic primer
acactggtctggcctgctac

SEQ ID NO: 611 - DNA, 19 bp, Artificial Sequence
  Synthetic primer
ggtaccagcctcgacacaa

SEQ ID NO: 612 - DNA, 18 bp, Artificial Sequence
  Synthetic primer
tgcaactgtgatgtgggg

SEQ ID NO: 613 - DNA, 20 bp, Artificial Sequence
  Synthetic primer
tggccactatcttcttcgtg

SEQ ID NO: 614 - DNA, 22 bp, Artificial Sequence
  Synthetic primer
gctccaggatgtgtttctgttg

SEQ ID NO: 615 - DNA, 19 bp, Artificial Sequence
  Synthetic primer
atggccattcctgttccag

SEQ ID NO: 616 - DNA, 20 bp, Artificial Sequence
  Synthetic primer
cgcgagcccctcattataca

SEQ ID NO: 617 - DNA, 20 bp, Artificial Sequence
  Synthetic primer
ctcgaggacagctccaacat

SEQ ID NO: 618 - DNA, 20 bp, Artificial Sequence
  Synthetic primer
cagcatggtagtggcaaaga

SEQ ID NO: 619 - DNA, 20 bp, Artificial Sequence
  Synthetic primer
gagagagccagtctgatcca

SEQ ID NO: 620 - DNA, 18 bp, Artificial Sequence
  Synthetic primer
tccgcaagacacctcctg

SEQ ID NO: 621 - DNA, 20 bp, Artificial Sequence
  Synthetic primer
ctgtgccctctacaaccagg

SEQ ID NO: 622 - DNA, 20 bp, Artificial Sequence
  Synthetic primer
ccaacaccttcttggcttct

SEQ ID NO: 623 - DNA, 19 bp, Artificial Sequence
  Synthetic primer
ccgcatcttctgctcttgt

SEQ ID NO: 624 - DNA, 21 bp, Artificial Sequence
  Synthetic primer
agaggctgaatatgcaggaca

SEQ ID NO: 625 - DNA, 19 bp, Artificial Sequence
  Synthetic primer
cttgccctccaacaaggtc

SEQ ID NO: 626 - DNA, 19 bp, Artificial Sequence
  Synthetic primer
atgcgacccacgtctacat

SEQ ID NO: 627 - DNA, 20 bp, Artificial Sequence
  Synthetic primer
atcgtcagcgagtttgacct

SEQ ID NO: 628 - DNA, 18 bp, Artificial Sequence
  Synthetic primer
tccgccacctcttcctct

SEQ ID NO: 629 - DNA, 18 bp, Artificial Sequence
  Synthetic primer
gcctgagtctcctgtgcc

SEQ ID NO: 630 - DNA, 19 bp, Artificial Sequence
  Synthetic primer
gctgagacccactgacctg

SEQ ID NO: 631 - DNA, 18 bp, Artificial Sequence
  Synthetic primer
gcgcagaggccagttaaa

SEQ ID NO: 632 - DNA, 20 bp, Artificial Sequence
  Synthetic primer
cttcgagatctccctctgga

SEQ ID NO: 633 - DNA, 19 bp, Artificial Sequence
  Synthetic primer
tttaccgatgcacctgtcc

SEQ ID NO: 634 - DNA, 20 bp, Artificial Sequence
  Synthetic primer
cccaatcggaagcctaacta

SEQ ID NO: 635 - DNA, 18 bp, Artificial Sequence
  Synthetic primer
gaggaaaagtcagggccg

SEQ ID NO: 636 - DNA, 20 bp, Artificial Sequence
  Synthetic primer
tgaagagaggcatgttggag

SEQ ID NO: 637 - DNA, 20 bp, Artificial Sequence
  Synthetic primer
tcaagagtctcagcagccaa

SEQ ID NO: 638 - DNA, 23 bp, Artificial Sequence
  Synthetic primer
tcttccctgtacactggcagttc

SEQ ID NO: 639 - DNA, 19 bp, Artificial Sequence
  Synthetic primer
ggcacagtgcaagtgatga

SEQ ID NO: 640 - DNA, 19 bp, Artificial Sequence
  Synthetic primer
cctgagttgttcacagggc

SEQ ID NO: 641 - DNA, 19 bp, Artificial Sequence
  Synthetic primer
ggcagcttccttgaaccat

SEQ ID NO: 642 - DNA, 22 bp, Artificial Sequence
  Synthetic primer
cagaccagtccctggtcatagg

SEQ ID NO: 643 - DNA, 20 bp, Artificial Sequence
  Synthetic primer
ggacccgtctacaggtgaac

SEQ ID NO: 644 - DNA, 20 bp, Artificial Sequence
  Synthetic primer
gggctcagctttcagaagtg

SEQ ID NO: 645 - DNA, 20 bp, Artificial Sequence
  Synthetic primer
tcacatgccactttggtgtt

SEQ ID NO: 646 - DNA, 21 bp, Artificial Sequence
  Synthetic primer
gaggcgctcaacatgaaattc

SEQ ID NO: 647 - DNA, 20 bp, Artificial Sequence
  Synthetic primer
ccagtggtggtgatcgttca

SEQ ID NO: 648 - DNA, 18 bp, Artificial Sequence
  Synthetic primer
aaggaggccatcacccac

SEQ ID NO: 649 - DNA, 18 bp, Artificial Sequence
  Synthetic primer
ggactcggagacgctgtg

SEQ ID NO: 650 - DNA, 20 bp, Artificial Sequence
  Synthetic primer
catcttccaggaggaccact

SEQ ID NO: 651 - DNA, 20 bp, Artificial Sequence
  Synthetic primer
gagccatcttcctgcaactt

SEQ ID NO: 652 - DNA, 20 bp, Artificial Sequence
  Synthetic primer
cctggaggctgcaacatacc

SEQ ID NO: 653 - DNA, 21 bp, Artificial Sequence
  Synthetic primer
ccaagcctgtagtgtccttca

SEQ ID NO: 654 - DNA, 19 bp, Artificial Sequence
  Synthetic primer
gggacccaaagcatgaaat

SEQ ID NO: 655 - DNA, 20 bp, Artificial Sequence
  Synthetic primer
tgttttgattcccgggctta

SEQ ID NO: 656 - DNA, 20 bp, Artificial Sequence
  Synthetic primer
atcaccaaccggagaaagtc

SEQ ID NO: 657 - DNA, 20 bp, Artificial Sequence
  Synthetic primer
gatggagcaggtggctcagt

SEQ ID NO: 658 - DNA, 21 bp, Artificial Sequence
  Synthetic primer
gtatgctgctgaaagtgggaa

SEQ ID NO: 659 - DNA, 18 bp, Artificial Sequence
  Synthetic primer
cacaccctggaatgggag

SEQ ID NO: 660 - DNA, 18 bp, Artificial Sequence
  Synthetic primer
agcgaggatgaggacgtg

SEQ ID NO: 661 - DNA, 28 bp, Artificial Sequence
  Synthetic primer
acttcggtgctacttaacaacttacatc

SEQ ID NO: 662 - DNA, 23 bp, Artificial Sequence
  Synthetic primer
gacatggagaacaagctgtttgc

SEQ ID NO: 663 - DNA, 18 bp, Artificial Sequence
  Synthetic primer
cgtgtgacgtgcgagaga

SEQ ID NO: 664 - DNA, 18 bp, Artificial Sequence
  Synthetic primer
catgcctcaccagatgga

SEQ ID NO: 665 - DNA, 18 bp, Artificial Sequence
  Synthetic primer
ccgaatggtttccaggtg

SEQ ID NO: 666 - DNA, 20 bp, Artificial Sequence
  Synthetic primer
ggtgtgccacagaccttcct

SEQ ID NO: 667 - DNA, 22 bp, Artificial Sequence
  Synthetic primer
ctgtatttaaggacacccgtgc

SEQ ID NO: 668 - DNA, 20 bp, Artificial Sequence
  Synthetic primer
accagtcccccagaagacta

SEQ ID NO: 669 - DNA, 19 bp, Artificial Sequence
  Synthetic primer
gctacgagtgctgtcctgg

SEQ ID NO: 670 - DNA, 18 bp, Artificial Sequence
  Synthetic primer
gtcatcacctggccttgg

SEQ ID NO: 671 - DNA, 20 bp, Artificial Sequence
  Synthetic primer
aacaccaatgggttccatct

SEQ ID NO: 672 - DNA, 18 bp, Artificial Sequence
  Synthetic primer
agatctgcgacggactgc

SEQ ID NO: 673 - DNA, 22 bp, Artificial Sequence
  Synthetic primer
catccgcaaagtgactgaagag

SEQ ID NO: 674 - DNA, 19 bp, Artificial Sequence
  Synthetic primer
tccctgcggtcccagatag

SEQ ID NO: 675 - DNA, 22 bp, Artificial Sequence
  Synthetic primer
tcaccctctgtgacttcatcgt

SEQ ID NO: 676 - DNA, 20 bp, Artificial Sequence
  Synthetic primer
ctacctgccttgctttgtga

SEQ ID NO: 677 - DNA, 20 bp, Artificial Sequence
  Synthetic primer
gccgggaagaccgtaattgt

SEQ ID NO: 678 - DNA, 19 bp, Artificial Sequence
  Synthetic primer
ggttgggccacctagaagt

SEQ ID NO: 679 - DNA, 20 bp, Artificial Sequence
  Synthetic primer
ccctgaaagaatgttgtggc

SEQ ID NO: 680 - DNA, 22 bp, Artificial Sequence
  Synthetic primer
ggattccactgttagagccctt

SEQ ID NO: 681 - DNA, 20 bp, Artificial Sequence
  Synthetic primer
gaaatcgccagcttcgataa

SEQ ID NO: 682 - DNA, 20 bp, Artificial Sequence
  Synthetic primer
ggagaagggtgaccgactca

SEQ ID NO: 683 - DNA, 20 bp, Artificial Sequence
  Synthetic primer
atcgtcttggctgagaaagg

SEQ ID NO: 684 - DNA, 20 bp, Artificial Sequence
  Synthetic primer
aggagtgaaagatgggatgc

SEQ ID NO: 685 - DNA, 21 bp, Artificial Sequence
  Synthetic primer
ggagtttgaccagagatgcaa

SEQ ID NO: 686 - DNA, 19 bp, Artificial Sequence
  Synthetic primer
cctctcgcttctggtggtc

SEQ ID NO: 687 - DNA, 18 bp, Artificial Sequence
  Synthetic primer
tggcgaccaagacacctt

SEQ ID NO: 688 - DNA, 18 bp, Artificial Sequence
  Synthetic primer
actgccctgagcccaaat

SEQ ID NO: 689 - DNA, 18 bp, Artificial Sequence
  Synthetic primer
taggccaggagttcccaa

SEQ ID NO: 690 - DNA, 18 bp, Artificial Sequence
  Synthetic primer
cctacgccatgggacatc

SEQ ID NO: 691 - DNA, 20 bp, Artificial Sequence
  Synthetic primer
ccaacctcactgggacactt

SEQ ID NO: 692 - DNA, 18 bp, Artificial Sequence
  Synthetic primer
catgtcagaaagggccga

SEQ ID NO: 693 - DNA, 20 bp, Artificial Sequence
  Synthetic primer
aatccaagggggagagtgat

SEQ ID NO: 694 - DNA, 21 bp, Artificial Sequence
  Synthetic primer
tgtggacatcttcccctcaga

SEQ ID NO: 695 - DNA, 24 bp, Artificial Sequence
  Synthetic primer
ctatatgcagccagagatgtgaca

SEQ ID NO: 696 - DNA, 22 bp, Artificial Sequence
  Synthetic primer
cttcacagtgctcctgcagtct

SEQ ID NO: 697 - DNA, 18 bp, Artificial Sequence
  Synthetic primer
gcctcggtgtgcctttca

SEQ ID NO: 698 - DNA, 18 bp, Artificial Sequence
  Synthetic primer
tcaccaaatctcagcccg

SEQ ID NO: 699 - DNA, 20 bp, Artificial Sequence
  Synthetic primer
cacagtggcctctttctcct

SEQ ID NO: 700 - DNA, 19 bp, Artificial Sequence
  Synthetic primer
atcactggggtgatcctgc

SEQ ID NO: 701 - DNA, 21 bp, Artificial Sequence
  Synthetic primer
cagaaatctctgcaggcaagt

SEQ ID NO: 702 - DNA, 20 bp, Artificial Sequence
  Synthetic primer
cgaggacgaggcttaaaaac

SEQ ID NO: 703 - DNA, 18 bp, Artificial Sequence
  Synthetic primer
caccaagaacgggcagaa

SEQ ID NO: 704 - DNA, 20 bp, Artificial Sequence
  Synthetic primer
ggaggagctaaatgcctcag

SEQ ID NO: 705 - DNA, 18 bp, Artificial Sequence
  Synthetic primer
gccagaacggctcagtct

SEQ ID NO: 706 - DNA, 18 bp, Artificial Sequence
  Synthetic primer
gagtcgaccctgcacctg

SEQ ID NO: 707 - DNA, 20 bp, Artificial Sequence
  Synthetic primer
gaatgcacgctggaacttta

SEQ ID NO: 708 - DNA, 20 bp, Artificial Sequence
  Synthetic primer
tgtctggcgataaagggatt

SEQ ID NO: 709 - DNA, 20 bp, Artificial Sequence
  Synthetic primer
tgttctcaaattgccaccaa

SEQ ID NO: 710 - DNA, 20 bp, Artificial Sequence
  Synthetic primer
ggcaactgacaaacagcctt

SEQ ID NO: 711 - DNA, 18 bp, Artificial Sequence
  Synthetic primer
gcgtggacctggatgagt

SEQ ID NO: 712 - DNA, 19 bp, Artificial Sequence
  Synthetic primer
gtggatgtgccctgaagga

SEQ ID NO: 713 - DNA, 18 bp, Artificial Sequence
  Synthetic primer
aagctgtgatggccaagc

SEQ ID NO: 714 - DNA, 21 bp, Artificial Sequence
  Synthetic primer
tggcttcaggagctgaatacc

SEQ ID NO: 715 - DNA, 20 bp, Artificial Sequence
  Synthetic primer
cctgctacacagccaacaag

SEQ ID NO: 716 - DNA, 20 bp, Artificial Sequence
  Synthetic primer
gccctggatttcagaaagag

SEQ ID NO: 717 - DNA, 20 bp, Artificial Sequence
  Synthetic primer
ctgctgtcttgggtgcattg

SEQ ID NO: 718 - DNA, 19 bp, Artificial Sequence
  Synthetic primer
tgacgatggcctggagtgt

SEQ ID NO: 719 - DNA, 19 bp, Artificial Sequence
  Synthetic primer
cggttggtgacttgtctgc

SEQ ID NO: 720 - DNA, 21 bp, Artificial Sequence
  Synthetic primer
tgcccttaaaggaaccaatga

SEQ ID NO: 721 - DNA, 18 bp, Artificial Sequence
  Synthetic primer
acagtggtctgggcatcc

SEQ ID NO: 722 - DNA, 19 bp, Artificial Sequence
  Synthetic primer
agtcaatcttcgcacacgg

SEQ ID NO: 723 - DNA, 19 bp, Artificial Sequence
  Synthetic primer
tgaagcacagtgccctctc

SEQ ID NO: 724 - DNA, 19 bp, Artificial Sequence
  Synthetic primer
aacaagctgagtgcccagg

SEQ ID NO: 725 - DNA, 22 bp, Artificial Sequence
  Synthetic primer
agaggcatccatgaacttcaca

SEQ ID NO: 726 - DNA, 19 bp, Artificial Sequence
  Synthetic primer
tgtacggtcggcatctgag

SEQ ID NO: 727 - DNA, 20 bp, Artificial Sequence
  Synthetic primer
atcgcagctggtgggtgtac

SEQ ID NO: 728 - DNA, 18 bp, Artificial Sequence
  Synthetic primer
tggtggcagacatccctt

SEQ ID NO: 729 - DNA, 23 bp, Artificial Sequence
  Synthetic primer
gcagttggaagacacaggaaagt

SEQ ID NO: 730 - DNA, 20 bp, Artificial Sequence
  Synthetic primer
caccctgcactgaacatacc

SEQ ID NO: 731 - DNA, 25 bp, Artificial Sequence
  Synthetic primer
agactgtggagtttgatgttgttga

SEQ ID NO: 732 - DNA, 20 bp, Artificial Sequence
  Synthetic primer
gagtacgaccagttagcggc

SEQ ID NO: 733 - DNA, 22 bp, Artificial Sequence
  Synthetic primer
aggtccctgttggccttatagg

SEQ ID NO: 734 - DNA, 18 bp, Artificial Sequence
  Synthetic primer
ccgtttgcacagatgcag

SEQ ID NO: 735 - DNA, 20 bp, Artificial Sequence
  Synthetic primer
ctccatccactccaggtctc

SEQ ID NO: 736 - DNA, 20 bp, Artificial Sequence
  Synthetic primer
caagcctggaacctatagcc

SEQ ID NO: 737 - DNA, 21 bp, Artificial Sequence
  Synthetic primer
aagacagcccagtcctcaaat

SEQ ID NO: 738 - DNA, 18 bp, Artificial Sequence
  Synthetic primer
ccgtgtctgtgaagccgt

SEQ ID NO: 739 - DNA, 19 bp, Artificial Sequence
  Synthetic primer
taatggcctcagctgcttg

SEQ ID NO: 740 - DNA, 21 bp, Artificial Sequence
  Synthetic primer
cgggcactcactgctattacc

SEQ ID NO: 741 - DNA, 19 bp, Artificial Sequence
  Synthetic primer
tgatgacctgctttggtgc

SEQ ID NO: 742 - DNA, 21 bp, Artificial Sequence
  Synthetic primer
atctacaaccttgggctgcaa

SEQ ID NO: 743 - DNA, 20 bp, Artificial Sequence
  Synthetic primer
atcgtggtattcatcgtggc

SEQ ID NO: 744 - DNA, 20 bp, Artificial Sequence
  Synthetic primer
aatttcctgaaggagcctga

SEQ ID NO: 745 - DNA, 23 bp, Artificial Sequence
  Synthetic primer
ggaaccaaaggtctcttcacaga

SEQ ID NO: 746 - DNA, 20 bp, Artificial Sequence
  Synthetic primer
cacagatggccagtgtttct

SEQ ID NO: 747 - DNA, 18 bp, Artificial Sequence
  Synthetic primer
cgacattggcagtcatcg

SEQ ID NO: 748 - DNA, 20 bp, Artificial Sequence
  Synthetic primer
tcgttcacaggagtcaccat

SEQ ID NO: 749 - DNA, 20 bp, Artificial Sequence
  Synthetic primer
caatttgcggctctagcttc

SEQ ID NO: 750 - DNA, 22 bp, Artificial Sequence
  Synthetic primer
aaaatgcaagaagtcacaggaa

SEQ ID NO: 751 - DNA, 18 bp, Artificial Sequence
  Synthetic primer
aacgattccagccccttc

SEQ ID NO: 752 - DNA, 18 bp, Artificial Sequence
  Synthetic primer
tgggcgcctaaatcctaa

SEQ ID NO: 753 - DNA, 20 bp, Artificial Sequence
  Synthetic primer
tctgatctccatctgcctca

SEQ ID NO: 754 - DNA, 20 bp, Artificial Sequence
  Synthetic primer
ccagttgagggagttttgct

SEQ ID NO: 755 - DNA, 19 bp, Artificial Sequence
  Synthetic primer
ctacaagcattgtgcgtcg

SEQ ID NO: 756 - DNA, 19 bp, Artificial Sequence
  Synthetic primer
acatcttgtgggaaaggca

SEQ ID NO: 757 - DNA, 22 bp, Artificial Sequence
  Synthetic primer
tcaggatcatttttaggatggc

SEQ ID NO: 758 - DNA, 20 bp, Artificial Sequence
  Synthetic primer
tcccggtacaccacgttctt

SEQ ID NO: 759 - DNA, 21 bp, Artificial Sequence
  Synthetic primer
ggcggtaaattcatcatcgaa

SEQ ID NO: 760 - DNA, 24 bp, Artificial Sequence
  Synthetic primer
ccagcattagattctccaacttga

SEQ ID NO: 761 - DNA, 20 bp, Artificial Sequence
  Synthetic primer
aaccggaagaagtcgatgag

SEQ ID NO: 762 - DNA, 18 bp, Artificial Sequence
  Synthetic primer
gcatgctccaccagctct

SEQ ID NO: 763 - DNA, 19 bp, Artificial Sequence
  Synthetic primer
tcatcggagcttgatctcg

SEQ ID NO: 764 - DNA, 20 bp, Artificial Sequence
  Synthetic primer
taacttgattcccaccacga

SEQ ID NO: 765 - DNA, 18 bp, Artificial Sequence
  Synthetic primer
agcactagcctggagggc

SEQ ID NO: 766 - DNA, 18 bp, Artificial Sequence
  Synthetic primer
gaagcctgaggacttgcg

SEQ ID NO: 767 - DNA, 18 bp, Artificial Sequence
  Synthetic primer
gacagcccagagacccac

SEQ ID NO: 768 - DNA, 20 bp, Artificial Sequence
  Synthetic primer
cctttttaaagcccgacagt

SEQ ID NO: 769 - DNA, 20 bp, Artificial Sequence
  Synthetic primer
ttgcagtgggaagaacagtc

SEQ ID NO: 770 - DNA, 21 bp, Artificial Sequence
  Synthetic primer
tagctcctgcttatgcactcg

SEQ ID NO: 771 - DNA, 21 bp, Artificial Sequence
  Synthetic primer
tgctttgtgatcccaagtaga

SEQ ID NO: 772 - DNA, 19 bp, Artificial Sequence
  Synthetic primer
ccggttgaagtccactgag

SEQ ID NO: 773 - DNA, 20 bp, Artificial Sequence
  Synthetic primer
gccatccaggtgcttattgt

SEQ ID NO: 774 - DNA, 20 bp, Artificial Sequence
  Synthetic primer
gagaaggctgggagactctg

SEQ ID NO: 775 - DNA, 24 bp, Artificial Sequence
  Synthetic primer
cctttaaccattatggccttatgc

SEQ ID NO: 776 - DNA, 19 bp, Artificial Sequence
  Synthetic primer
cgtgtcgggcttcagtcat

SEQ ID NO: 777 - DNA, 19 bp, Artificial Sequence
  Synthetic primer
ctcatacaggtcctgggca

SEQ ID NO: 778 - DNA, 19 bp, Artificial Sequence
  Synthetic primer
agaaccaccaacatccgct

SEQ ID NO: 779 - DNA, 20 bp, Artificial Sequence
  Synthetic primer
tagccataaggtccgctctc

SEQ ID NO: 780 - DNA, 20 bp, Artificial Sequence
  Synthetic primer
ctgaggcggtatgacatgag

SEQ ID NO: 781 - DNA, 20 bp, Artificial Sequence
  Synthetic primer
catcctggttcacctttcaa

SEQ ID NO: 782 - DNA, 20 bp, Artificial Sequence
  Synthetic primer
acccactcgatttgtttctg

SEQ ID NO: 783 - DNA, 20 bp, Artificial Sequence
  Synthetic primer
cactctgaatccttgctgga

SEQ ID NO: 784 - DNA, 18 bp, Artificial Sequence
  Synthetic primer
cctgcaccttctccacca

SEQ ID NO: 785 - DNA, 18 bp, Artificial Sequence
  Synthetic primer
attttgtcctggcccctg

SEQ ID NO: 786 - DNA, 20 bp, Artificial Sequence
  Synthetic primer
agagatcttgaggtcgtggc

SEQ ID NO: 787 - DNA, 19 bp, Artificial Sequence
  Synthetic primer
aaggctgacctctcccctc

SEQ ID NO: 788 - DNA, 27 bp, Artificial Sequence
  Synthetic primer
ttgtggttcgttatcatactcttctga

SEQ ID NO: 789 - DNA, 20 bp, Artificial Sequence
  Synthetic primer
acaagcacatggctatggaa

SEQ ID NO: 790 - DNA, 19 bp, Artificial Sequence
  Synthetic primer
ccacatcgattcagccaag

SEQ ID NO: 791 - DNA, 18 bp, Artificial Sequence
  Synthetic primer
gaagctagaggcccgctc

SEQ ID NO: 792 - DNA, 18 bp, Artificial Sequence
  Synthetic primer
gtcgcaaactcggagacg

SEQ ID NO: 793 - DNA, 20 bp, Artificial Sequence
  Synthetic primer
tgatggaggatcagagggag

SEQ ID NO: 794 - DNA, 21 bp, Artificial Sequence
  Synthetic primer
ggtttggagggatctcaaagg

SEQ ID NO: 795 - DNA, 20 bp, Artificial Sequence
  Synthetic primer
tgcgtactccatcaggtcat

SEQ ID NO: 796 - DNA, 18 bp, Artificial Sequence
  Synthetic primer
ggcagaaagaggtggcag

SEQ ID NO: 797 - DNA, 21 bp, Artificial Sequence
  Synthetic primer
tgggagtatcggatgtagctg

SEQ ID NO: 798 - DNA, 18 bp, Artificial Sequence
  Synthetic primer
ggtgatgatccgctcgat

SEQ ID NO: 799 - DNA, 19 bp, Artificial Sequence
  Synthetic primer
ctgcacagagaaggggagg

SEQ ID NO: 800 - DNA, 18 bp, Artificial Sequence
  Synthetic primer
gtcccgggttgttgagaa

SEQ ID NO: 801 - DNA, 23 bp, Artificial Sequence
  Synthetic primer
tcagatgacgaagagcacagatg

SEQ ID NO: 802 - DNA, 21 bp, Artificial Sequence
  Synthetic primer
tggaattcatccaatccaaat

SEQ ID NO: 803 - DNA, 21 bp, Artificial Sequence
  Synthetic primer
ctgctcactcggctcaaactc

SEQ ID NO: 804 - DNA, 24 bp, Artificial Sequence
  Synthetic primer
gttcaacctcttcctgtggactgt

SEQ ID NO: 805 - DNA, 20 bp, Artificial Sequence
  Synthetic primer
ctaaatgcccaaggtgactg

SEQ ID NO: 806 - DNA, 20 bp, Artificial Sequence
  Synthetic primer
gggaacatagacccaccaat

SEQ ID NO: 807 - DNA, 21 bp, Artificial Sequence
  Synthetic primer
ttgccgtcagaaaacatgtca

SEQ ID NO: 808 - DNA, 19 bp, Artificial Sequence
  Synthetic primer
ctaattgggctccatctcg

SEQ ID NO: 809 - DNA, 24 bp, Artificial Sequence
  Synthetic primer
cctatgatttaagggcatttttcc

SEQ ID NO: 810 - DNA, 20 bp, Artificial Sequence
  Synthetic primer
tgaagctgttgaggcaatgt

SEQ ID NO: 811 - DNA, 18 bp, Artificial Sequence
  Synthetic primer
ctcagctgacgggaaagg

SEQ ID NO: 812 - DNA, 19 bp, Artificial Sequence
  Synthetic primer
cagcggttgaagcgttcct

SEQ ID NO: 813 - DNA, 20 bp, Artificial Sequence
  Synthetic primer
gccacgtgattcttccacaa

SEQ ID NO: 814 - DNA, 24 bp, Artificial Sequence
  Synthetic primer
tggtgatgggagttgtattttcag

SEQ ID NO: 815 - DNA, 20 bp, Artificial Sequence
  Synthetic primer
cttgttgttcaccaggacga

SEQ ID NO: 816 - DNA, 18 bp, Artificial Sequence
  Synthetic primer
ttgaacctccgtccttcg

SEQ ID NO: 817 - DNA, 21 bp, Artificial Sequence
  Synthetic primer
ggcaggagtgaatggctcttc

SEQ ID NO: 818 - DNA, 20 bp, Artificial Sequence
  Synthetic primer
cgtggttgactctgatctcg

SEQ ID NO: 819 - DNA, 18 bp, Artificial Sequence
  Synthetic primer
agcgctgtttcggtcaga

SEQ ID NO: 820 - DNA, 20 bp, Artificial Sequence
  Synthetic primer
ggtatcttgtggtgtctgcg

SEQ ID NO: 821 - DNA, 20 bp, Artificial Sequence
  Synthetic primer
ccattccagttgatctgtgg

SEQ ID NO: 822 - DNA, 20 bp, Artificial Sequence
  Synthetic primer
tgaagcagtcagttgtgctg

SEQ ID NO: 823 - DNA, 21 bp, Artificial Sequence
  Synthetic primer
aagacatggcgctctcagttc

SEQ ID NO: 824 - DNA, 22 bp, Artificial Sequence
  Synthetic primer
gctgattcccaagagtctaacc

SEQ ID NO: 825 - DNA, 18 bp, Artificial Sequence
  Synthetic primer
ggcactcggcttgagcat

SEQ ID NO: 826 - DNA, 21 bp, Artificial Sequence
  Synthetic primer
caagggctgattttaaggtga

SEQ ID NO: 827 - DNA, 18 bp, Artificial Sequence
  Synthetic primer
cgggtacagtgcagacga

SEQ ID NO: 828 - DNA, 20 bp, Artificial Sequence
  Synthetic primer
cccatgggatcttcatcatc

SEQ ID NO: 829 - DNA, 24 bp, Artificial Sequence
  Synthetic primer
acggtcctaggtttgaggttaaga

SEQ ID NO: 830 - DNA, 18 bp, Artificial Sequence
  Synthetic primer
actcggtgtccgggactt

SEQ ID NO: 831 - DNA, 19 bp, Artificial Sequence
  Synthetic primer
tgttaagtgcccttgctgg

SEQ ID NO: 832 - DNA, 20 bp, Artificial Sequence
  Synthetic primer
aggccttatgctggtgacag

SEQ ID NO: 833 - DNA, 19 bp, Artificial Sequence
  Synthetic primer
acaggaactgaggggtgct

SEQ ID NO: 834 - DNA, 19 bp, Artificial Sequence
  Synthetic primer
ctgtaagtgccatccaggg

SEQ ID NO: 835 - DNA, 20 bp, Artificial Sequence
  Synthetic primer
ctgccttctcatctgcacaa

SEQ ID NO: 836 - DNA, 18 bp, Artificial Sequence
  Synthetic primer
cagccagtgggtgcctta

SEQ ID NO: 837 - DNA, 23 bp, Artificial Sequence
  Synthetic primer
gcgaattagccctctacaactga

SEQ ID NO: 838 - DNA, 20 bp, Artificial Sequence
  Synthetic primer
tgtgggatgtctccaagaaa

SEQ ID NO: 839 - DNA, 18 bp, Artificial Sequence
  Synthetic primer
gtggggactgtccactgc

SEQ ID NO: 840 - DNA, 20 bp, Artificial Sequence
  Synthetic primer
aattgcacttgggtctttgc

SEQ ID NO: 841 - DNA, 18 bp, Artificial Sequence
  Synthetic primer
ccttcctgcgtggtccat

SEQ ID NO: 842 - DNA, 23 bp, Artificial Sequence
  Synthetic primer
tccggtttaagaccagtttacca

SEQ ID NO: 843 - DNA, 20 bp, Artificial Sequence
  Synthetic primer
caatggcctccattttacag

SEQ ID NO: 844 - DNA, 19 bp, Artificial Sequence
  Synthetic primer
ctcctggtcacccttctgg

SEQ ID NO: 845 - DNA, 19 bp, Artificial Sequence
  Synthetic primer
tggaatctgccaggaggta

SEQ ID NO: 846 - DNA, 20 bp, Artificial Sequence
  Synthetic primer
cctctgcacggtcataggtt

SEQ ID NO: 847 - DNA, 18 bp, Artificial Sequence
  Synthetic primer
cgccgcagaggtggagta

SEQ ID NO: 848 - DNA, 23 bp, Artificial Sequence
  Synthetic primer
ccttccctgaagacttcctgtct

SEQ ID NO: 849 - DNA, 20 bp, Artificial Sequence
  Synthetic primer
atgctgacttccttcctggt

SEQ ID NO: 850 - DNA, 20 bp, Artificial Sequence
  Synthetic primer
catcttcttgggcacacaat

SEQ ID NO: 851 - DNA, 22 bp, Artificial Sequence
  Synthetic primer
cggtgtagatgcacagcttctc

SEQ ID NO: 852 - DNA, 20 bp, Artificial Sequence
  Synthetic primer
gagcctctggatggtgcaat

SEQ ID NO: 853 - DNA, 25 bp, Artificial Sequence
  Synthetic primer
ttcaatgataatgcaaggactgatc

SEQ ID NO: 854 - DNA, 27 bp, Artificial Sequence
  Synthetic primer
acccaaattgtgatatacaaaaaggtt

SEQ ID NO: 855 - DNA, 19 bp, Artificial Sequence
  Synthetic primer
tcgtaggctttcgtgagga

SEQ ID NO: 856 - DNA, 20 bp, Artificial Sequence
  Synthetic primer
gactctcactgccctatgcc

SEQ ID NO: 857 - DNA, 20 bp, Artificial Sequence
  Synthetic primer
agagtttctgtggcctggat

SEQ ID NO: 858 - DNA, 20 bp, Artificial Sequence
  Synthetic primer
ctggtttgtctggagaaggc

SEQ ID NO: 859 - DNA, 20 bp, Artificial Sequence
  Synthetic primer
cctgacatttcccttgtcct

SEQ ID NO: 860 - DNA, 20 bp, Artificial Sequence
  Synthetic primer
tttttccgctgtggtgatga

SEQ ID NO: 861 - DNA, 18 bp, Artificial Sequence
  Synthetic primer
gcatggtgccggttatct

SEQ ID NO: 862 - DNA, 24 bp, Artificial Sequence
  Synthetic primer
ggttaattggtgacatcctcaaga

SEQ ID NO: 863 - DNA, 20 bp, Artificial Sequence
  Synthetic primer
tcatgggcgtatctacgaat

SEQ ID NO: 864 - DNA, 25 bp, Artificial Sequence
  Synthetic primer
gagagagtgagaccacgaagagact

SEQ ID NO: 865 - DNA, 20 bp, Artificial Sequence
  Synthetic primer
tgttgtatggggcattgact

SEQ ID NO: 866 - DNA, 23 bp, Artificial Sequence
  Synthetic primer
ttagcctgaggaattgctgtgtt

SEQ ID NO: 867 - DNA, 19 bp, Artificial Sequence
  Synthetic primer
caggagtttacctgcccct

SEQ ID NO: 868 - DNA, 19 bp, Artificial Sequence
  Synthetic primer
aaggttcgaagatggcacc

SEQ ID NO: 869 - DNA, 21 bp, Artificial Sequence
  Synthetic primer
tgcctctgtaatcggcaactg

SEQ ID NO: 870 - DNA, 18 bp, Artificial Sequence
  Synthetic primer
tccctgcattcaagaggc

SEQ ID NO: 871 - DNA, 20 bp, Artificial Sequence
  Synthetic primer
gatgctcatggtgaatgagg

SEQ ID NO: 872 - DNA, 20 bp, Artificial Sequence
  Synthetic primer
actggggtggaatgtgtctt

SEQ ID NO: 873 - DNA, 21 bp, Artificial Sequence
  Synthetic primer
ttgggttgaagaaatcagtcc

SEQ ID NO: 874 - DNA, 20 bp, Artificial Sequence
  Synthetic primer
tgcagaaatgactggatgga

SEQ ID NO: 875 - DNA, 19 bp, Artificial Sequence
  Synthetic primer
ctcctccaccctgggttgt

SEQ ID NO: 876 - DNA, 20 bp, Artificial Sequence
  Synthetic primer
gacctcagggcgattcatga

SEQ ID NO: 877 - DNA, 19 bp, Artificial Sequence
  Synthetic primer
gggcacagtatcccaggta

SEQ ID NO: 878 - DNA, 20 bp, Artificial Sequence
  Synthetic primer
accatcactgcctccttttc

SEQ ID NO: 879 - DNA, 21 bp, Artificial Sequence
  Synthetic primer
ctgcattgtggcacagttctg

SEQ ID NO: 880 - DNA, 20 bp, Artificial Sequence
  Synthetic primer
gttggtgatgttccgaagca

SEQ ID NO: 881 - DNA, 21 bp, Artificial Sequence
  Synthetic primer
cagccgctttcagattttcat

SEQ ID NO: 882 - DNA, 19 bp, Artificial Sequence
  Synthetic primer
cctctctgtggacctgcct

SEQ ID NO: 883 - DNA, 18 bp, Artificial Sequence
  Synthetic primer
ccaggggactcagatgga

SEQ ID NO: 884 - DNA, 20 bp, Artificial Sequence
  Synthetic primer
gatctccgccactgattctg

SEQ ID NO: 885 - DNA, 22 bp, Artificial Sequence
  Synthetic primer
cagcagtgaggtggtactctga

SEQ ID NO: 886 - DNA, 20 bp, Artificial Sequence
  Synthetic primer
ctcgaaggatgtaaacgggt

SEQ ID NO: 887 - DNA, 18 bp, Artificial Sequence
  Synthetic primer
ttgggatgctcaaaagcc

SEQ ID NO: 888 - DNA, 18 bp, Artificial Sequence
  Synthetic primer
gcaggtgggaatccaggt

SEQ ID NO: 889 - DNA, 20 bp, Artificial Sequence
  Synthetic primer
tcatgaagtcgacagcttcc

SEQ ID NO: 890 - DNA, 22 bp, Artificial Sequence
  Synthetic primer
tggcaaatccgaattagagtga

SEQ ID NO: 891 - DNA, 18 bp, Artificial Sequence
  Synthetic primer
gtctcagacccttccccc

SEQ ID NO: 892 - DNA, 18 bp, Artificial Sequence
  Synthetic primer
gggtgagtctggccttca

SEQ ID NO: 893 - DNA, 18 bp, Artificial Sequence
  Synthetic primer
cggcgcttctctcctaca

SEQ ID NO: 894 - DNA, 20 bp, Artificial Sequence
  Synthetic primer
caaaaccgctgtgtttcttc

SEQ ID NO: 895 - DNA, 24 bp, Artificial Sequence
  Synthetic primer
gggtgccaagtaactgactattca

SEQ ID NO: 896 - DNA, 22 bp, Artificial Sequence
  Synthetic primer
cagtccacagcacggttatacc

SEQ ID NO: 897 - DNA, 19 bp, Artificial Sequence
  Synthetic primer
ggaaaatgcctccggtgtt

SEQ ID NO: 898 - DNA, 25 bp, Artificial Sequence
  Synthetic primer
cttctcatcaaggcagaaaaatctt

SEQ ID NO: 899 - DNA, 22 bp, Artificial Sequence
  Synthetic primer
ggttcaacagctcaaagaggtt

SEQ ID NO: 900 - DNA, 20 bp, Artificial Sequence
  Synthetic primer
gatagtaaaatgcggtcggc

SEQ ID NO: 901 - DNA, 20 bp, Artificial Sequence
  Synthetic primer
gtacccagccttgctctcat

SEQ ID NO: 902 - DNA, 18 bp, Artificial Sequence
  Synthetic primer
tgcgggacttgggaaaga

SEQ ID NO: 903 - DNA, 20 bp, Artificial Sequence
  Synthetic primer
ctccgatcgcacacatttgt

SEQ ID NO: 904 - DNA, 22 bp, Artificial Sequence
  Synthetic primer
cggttgttgctgatctgtctca

SEQ ID NO: 905 - DNA, 20 bp, Artificial Sequence
  Synthetic primer
gtggctacttggaggcagtc

SEQ ID NO: 906 - DNA, 23 bp, Artificial Sequence
  Synthetic primer
cagtggtaggtgatgttctggga

SEQ ID NO: 907 - DNA, 19 bp, Artificial Sequence
  Synthetic primer
aaactggctgccagcattg

SEQ ID NO: 908 - DNA, 20 bp, Artificial Sequence
  Synthetic primer
gagtcccaggaagacctgct

SEQ ID NO: 909 - DNA, 20 bp, Artificial Sequence
  Synthetic primer
cgcagtggtagagagccagt

SEQ ID NO: 910 - DNA, 19 bp, Artificial Sequence
  Synthetic primer
gcctggaggtccaactctg

SEQ ID NO: 911 - DNA, 18 bp, Artificial Sequence
  Synthetic primer
accaggctctcccttgct

SEQ ID NO: 912 - DNA, 21 bp, Artificial Sequence
  Synthetic primer
gccgaggcttttctaccagaa

SEQ ID NO: 913 - DNA, 18 bp, Artificial Sequence
  Synthetic primer
ccaggatgccaagatgct

SEQ ID NO: 914 - DNA, 20 bp, Artificial Sequence
  Synthetic primer
cagcggcaaaagcttctcta

SEQ ID NO: 915 - DNA, 22 bp, Artificial Sequence
  Synthetic primer
gagtgaaagtcaggattcagcc

SEQ ID NO: 916 - DNA, 20 bp, Artificial Sequence
  Synthetic primer
tgaccgtgccagcatttaca

SEQ ID NO: 917 - DNA, 19 bp, Artificial Sequence
  Synthetic primer
ctccagatagggagctggg

SEQ ID NO: 918 - DNA, 25 bp, Artificial Sequence
  Synthetic primer
caactgttcctggtctacaaactca

SEQ ID NO: 919 - DNA, 20 bp, Artificial Sequence
  Synthetic primer
cctgcagagatgggtatgaa

SEQ ID NO: 920 - DNA, 20 bp, Artificial Sequence
  Synthetic primer
ctcatctggccggtctcact

SEQ ID NO: 921 - DNA, 20 bp, Artificial Sequence
  Synthetic primer
ctagaggctggtgccactgt

SEQ ID NO: 922 - DNA, 22 bp, Artificial Sequence
  Synthetic primer
ggaggacaggagctttttctca

SEQ ID NO: 923 - DNA, 20 bp, Artificial Sequence
  Synthetic primer
agttgtaatggcaggcacag

SEQ ID NO: 924 - DNA, 20 bp, Artificial Sequence
  Synthetic primer
gcaggaagtccgaatacaca

SEQ ID NO: 925 - DNA, 21 bp, Artificial Sequence
  Synthetic primer
gggacagcttgtagcctttgc

SEQ ID NO: 926 - DNA, 20 bp, Artificial Sequence
  Synthetic primer
catcgcttcctcgtcataga

SEQ ID NO: 927 - DNA, 19 bp, Artificial Sequence
  Synthetic primer
ccattgcagccttcattgc

SEQ ID NO: 928 - DNA, 19 bp, Artificial Sequence
  Synthetic primer
accattgcagccctgattg

SEQ ID NO: 929 - DNA, 22 bp, Artificial Sequence
  Synthetic primer
tccatggctttgtagggatagg

SEQ ID NO: 930 - DNA, 18 bp, Artificial Sequence
  Synthetic primer
gaatctcagcgtcagggc

SEQ ID NO: 931 - DNA, 21 bp, Artificial Sequence
  Synthetic primer
gcgaccacaagccttatcaag

SEQ ID NO: 932 - DNA, 20 bp, Artificial Sequence
  Synthetic primer
aatcccatatcccagatgga

SEQ ID NO: 933 - DNA, 20 bp, Artificial Sequence
  Synthetic primer
ggagtgttcctagcacctgg

SEQ ID NO: 934 - DNA, 21 bp, Artificial Sequence
  Synthetic primer
gctaaatgcaaccgtctcagt

SEQ ID NO: 935 - DNA, 20 bp, Artificial Sequence
  Synthetic primer
tagggaagtgatgggagagg

SEQ ID NO: 936 - DNA, 20 bp, Artificial Sequence
  Synthetic primer
tttgagatgcttgacgttgg

SEQ ID NO: 937 - DNA, 19 bp, Artificial Sequence
  Synthetic primer
caatgcggcatatactggg

SEQ ID NO: 938 - DNA, 21 bp, Artificial Sequence
  Synthetic primer
gttaccagaggctagccaaca

SEQ ID NO: 939 - DNA, 22 bp, Artificial Sequence
  Synthetic primer
aggataaggccaaccatgatgt

SEQ ID NO: 940 - DNA, 20 bp, Artificial Sequence
  Synthetic primer
gcagagtgcagacaaacacc

SEQ ID NO: 941 - DNA, 20 bp, Artificial Sequence
  Synthetic primer
agtgggatcacagggtgaag

SEQ ID NO: 942 - DNA, 18 bp, Artificial Sequence
  Synthetic primer
cagtggtcactgcatggg

SEQ ID NO: 943 - DNA, 19 bp, Artificial Sequence
  Synthetic primer
gcaaacctcatgccaatgc

SEQ ID NO: 944 - DNA, 20 bp, Artificial Sequence
  Synthetic primer
gtggctgcattagtgtccat

SEQ ID NO: 945 - DNA, 20 bp, Artificial Sequence
  Synthetic primer
atcccacttgtgctcctgtc

SEQ ID NO: 946 - DNA, 24 bp, Artificial Sequence
  Synthetic primer
tctctttcagcaacgatgtgtctt

SEQ ID NO: 947 - DNA, 18 bp, Artificial Sequence
  Synthetic primer
ggttgcatactcaggccc

SEQ ID NO: 948 - DNA, 20 bp, Artificial Sequence
  Synthetic primer
tgaatgccatctttcttcca

SEQ ID NO: 949 - DNA, 20 bp, Artificial Sequence
  Synthetic primer
gcctctctgttgaaacggtc

SEQ ID NO: 950 - DNA, 19 bp, Artificial Sequence
  Synthetic primer
agctctagggccatcacct

SEQ ID NO: 951 - DNA, 20 bp, Artificial Sequence
  Synthetic primer
ccacgtaatccaccatctcc

SEQ ID NO: 952 - DNA, 21 bp, Artificial Sequence
  Synthetic primer
tgctgacgcaattgtaatgat

SEQ ID NO: 953 - DNA, 19 bp, Artificial Sequence
  Synthetic primer
cccgcctggatctcaaact

SEQ ID NO: 954 - DNA, 21 bp, Artificial Sequence
  Synthetic primer
gcatcagccagtcctcaaact

SEQ ID NO: 955 - DNA, 26 bp, Artificial Sequence
  Synthetic primer
acacaaacactgtctgtacctgaaga

SEQ ID NO: 956 - DNA, 20 bp, Artificial Sequence
  Synthetic primer
agttttgctcgcctcatctt

SEQ ID NO: 957 - DNA, 20 bp, Artificial Sequence
  Synthetic primer
ggcagtgaaggcgataaagt

SEQ ID NO: 958 - DNA, 19 bp, Artificial Sequence
  Synthetic primer
atgaggctggagcttgagg

SEQ ID NO: 959 - DNA, 20 bp, Artificial Sequence
  Synthetic primer
cacctcttgctgtccctttg

SEQ ID NO: 960 - DNA, 18 bp, Artificial Sequence
  Synthetic primer
agaaggaaggtccagccg

SEQ ID NO: 961 - DNA, 18 bp, Artificial Sequence
  Synthetic primer
taagcccaggcgtcctct

SEQ ID NO: 962 - DNA, 18 bp, Artificial Sequence
  Synthetic primer
agtcgggtgttgaggggt

SEQ ID NO: 963 - DNA, 28 bp, Artificial Sequence
  Synthetic primer
tcttcatctgatttacaagctgtacatg

SEQ ID NO: 964 - DNA, 19 bp, Artificial Sequence
  Synthetic primer
ccatgaggcccaacttcct

SEQ ID NO: 965 - DNA, 20 bp, Artificial Sequence
  Synthetic primer
gacaaacacccttcctccag

SEQ ID NO: 966 - DNA, 21 bp, Artificial Sequence
  Synthetic primer
cccgcaaagaaaaagtaacag

SEQ ID NO: 967 - DNA, 20 bp, Artificial Sequence
  Synthetic primer
caggcctcagttccttcagt

SEQ ID NO: 968 - DNA, 18 bp, Artificial Sequence
  Synthetic primer
accgaaactgggtgatgg

SEQ ID NO: 969 - DNA, 22 bp, Artificial Sequence
  Synthetic primer
ttttgaagcatcagcttgagtt

SEQ ID NO: 970 - DNA, 20 bp, Artificial Sequence
  Synthetic primer
gcttgctgactgtgttccat

SEQ ID NO: 971 - DNA, 21 bp, Artificial Sequence
  Synthetic primer
tggacctagggcttccaagtc

SEQ ID NO: 972 - DNA, 20 bp, Artificial Sequence
  Synthetic primer
caggccgtaaggagctgtct

SEQ ID NO: 973 - DNA, 20 bp, Artificial Sequence
  Synthetic primer
ttacacatccaaccagtgcc

SEQ ID NO: 974 - DNA, 19 bp, Artificial Sequence
  Synthetic primer
accacagcatgggtgagag

SEQ ID NO: 975 - DNA, 20 bp, Artificial Sequence
  Synthetic primer
ccgttgtaacgttgactgga

SEQ ID NO: 976 - DNA, 21 bp, Artificial Sequence
  Synthetic primer
ggatagatcaccaagcccttc

SEQ ID NO: 977 - DNA, 21 bp, Artificial Sequence
  Synthetic primer
gtagtccccgctgaccttctc

SEQ ID NO: 978 - DNA, 27 bp, Artificial Sequence
  Synthetic primer
aaatacctgacacccttatgacaaatt

SEQ ID NO: 979 - DNA, 19 bp, Artificial Sequence
  Synthetic primer
attgggacagcttggatca

SEQ ID NO: 980 - DNA, 20 bp, Artificial Sequence
  Synthetic primer
ccaccattgccttagacctc

SEQ ID NO: 981 - DNA, 24 bp, Artificial Sequence
  Synthetic primer
ctccagcttagggtagttgtccat

SEQ ID NO: 982 - DNA, 19 bp, Artificial Sequence
  Synthetic primer
tgggtgacttccaccttca

SEQ ID NO: 983 - DNA, 20 bp, Artificial Sequence
  Synthetic primer
ttggtagtgctccacacgat

SEQ ID NO: 984 - DNA, 19 bp, Artificial Sequence
  Synthetic primer
aaccccaaagatccaggtg

SEQ ID NO: 985 - DNA, 21 bp, Artificial Sequence
  Synthetic primer
caccggcaaaataatactgga

SEQ ID NO: 986 - DNA, 20 bp, Artificial Sequence
  Synthetic primer
gaacagctggaggccaagtc

SEQ ID NO: 987 - DNA, 19 bp, Artificial Sequence
  Synthetic primer
aaccccaatgagtagggca

SEQ ID NO: 988 - DNA, 19 bp, Artificial Sequence
  Synthetic primer
cctggcatctgttggttca

SEQ ID NO: 989 - DNA, 20 bp, Artificial Sequence
  Synthetic primer
tccctggataattgggtctg

SEQ ID NO: 990 - DNA, 25 bp, Artificial Sequence
  Synthetic primer
tgctgatgttttctgacagaaagat

SEQ ID NO: 991 - DNA, 18 bp, Artificial Sequence
  Synthetic primer
cttgggctccaggtagca

SEQ ID NO: 992 - DNA, 18 bp, Artificial Sequence
  Synthetic primer
gtggcgtgcctcgaagtc

SEQ ID NO: 993 - DNA, 20 bp, Artificial Sequence
  Synthetic primer
gaagtgaacttgcggtaggc

SEQ ID NO: 994 - DNA, 19 bp, Artificial Sequence
  Synthetic primer
gtaatgctgtccacggtgc

SEQ ID NO: 995 - DNA, 20 bp, Artificial Sequence
  Synthetic primer
aggtacctctcggtcagtgg

SEQ ID NO: 996 - DNA, 19 bp, Artificial Sequence
  Synthetic primer
caagttggccctgtgacat

SEQ ID NO: 997 - DNA, 24 bp, Artificial Sequence
  Synthetic primer
gaactgagacccactgaagaaagg

SEQ ID NO: 998 - DNA, 25 bp, Artificial Sequence
  Synthetic primer
caaggcatatcgatcctcataaagt

SEQ ID NO: 999 - DNA, 20 bp, Artificial Sequence
  Synthetic primer
cggccaggatacacatctta

SEQ ID NO: 1000 - DNA, 18 bp, Artificial Sequence
  Synthetic primer
gggcgcacactactagcc

SEQ ID NO: 1001 - DNA, 24 bp, Artificial Sequence
  Synthetic primer
cacacctgcagtagttttgactca

SEQ ID NO: 1002 - DNA, 19 bp, Artificial Sequence
  Synthetic primer
cctccgccaggtctttagt

SEQ ID NO: 1003 - DNA, 20 bp, Artificial Sequence
  Synthetic primer
ctcatccgtcgggtcatagt

SEQ ID NO: 1004 - DNA, 20 bp, Artificial Sequence
  Synthetic primer
aaacggctcaaaggagtcaa

SEQ ID NO: 1005 - DNA, 23 bp, Artificial Sequence
  Synthetic primer
tgtagggcagacttcctcaaaca

SEQ ID NO: 1006 - DNA, 20 bp, Artificial Sequence
  Synthetic primer
agtctcttgggcatcgagtt

SEQ ID NO: 1007 - DNA, 20 bp, Artificial Sequence
  Synthetic primer
cctgaccgggtgatgttcac

SEQ ID NO: 1008 - DNA, 20 bp, Artificial Sequence
  Synthetic primer
aaccggtgctctccacattc

SEQ ID NO: 1009 - DNA, 19 bp, Artificial Sequence
  Synthetic primer
ccctgtcattgtctccagc

SEQ ID NO: 1010 - DNA, 21 bp, Artificial Sequence
  Synthetic primer
ctcttctcccagctggaaact

SEQ ID NO: 1011 - DNA, 18 bp, Artificial Sequence
  Synthetic primer
ggaagtgggtcatgtggg

SEQ ID NO: 1012 - DNA, 24 bp, Artificial Sequence
  Synthetic primer
ggcattaacacttttggacgataa

SEQ ID NO: 1013 - DNA, 24 bp, Artificial Sequence
  Synthetic primer
gcatgtaagaagaccctcactgaa

SEQ ID NO: 1014 - DNA, 20 bp, Artificial Sequence
  Synthetic primer
gttccaggaatgaaagcaca

SEQ ID NO: 1015 - DNA, 20 bp, Artificial Sequence
  Synthetic primer
tgcctttcgcacttggatct

SEQ ID NO: 1016 - DNA, 21 bp, Artificial Sequence
  Synthetic primer
aggaatgcagctactcactgg

SEQ ID NO: 1017 - DNA, 22 bp, Artificial Sequence
  Synthetic primer
tgcatttgttgtcctggatgtc

SEQ ID NO: 1018 - DNA, 18 bp, Artificial Sequence
  Synthetic primer
ctcatggcaaccagtccc

SEQ ID NO: 1019 - DNA, 20 bp, Artificial Sequence
  Synthetic primer
cagcctttccaggaacaaac

SEQ ID NO: 1020 - DNA, 20 bp, Artificial Sequence
  Synthetic primer
gttttgcagccttacccaat

SEQ ID NO: 1021 - DNA, 20 bp, Artificial Sequence
  Synthetic primer
aagtaagactgcaccctcgc

SEQ ID NO: 1022 - DNA, 19 bp, Artificial Sequence
  Synthetic primer
gggtgccatccacttcaca

SEQ ID NO: 1023 - DNA, 25 bp, Artificial Sequence
  Synthetic primer
gagtgagaattcgatccaagtcttc

SEQ ID NO: 1024 - DNA, 19 bp, Artificial Sequence
  Synthetic primer
caaaatgtccattgctgcc

SEQ ID NO: 1025 - DNA, 22 bp, Artificial Sequence
  Synthetic primer
ctctctgggtcgtctgaaacaa

SEQ ID NO: 1026 - DNA, 19 bp, Artificial Sequence
  Synthetic primer
ccttgtagctggagggacc

SEQ ID NO: 1027 - DNA, 19 bp, Artificial Sequence
  Synthetic primer
gccgcaggttctagttgct

SEQ ID NO: 1028 - DNA, 18 bp, Artificial Sequence
  Synthetic primer
ctgggatgacccgtcttg

SEQ ID NO: 1029 - DNA, 20 bp, Artificial Sequence
  Synthetic primer
tacgaggagaaaggggaaga

SEQ ID NO: 1030 - DNA, 18 bp, Artificial Sequence
  Synthetic primer
aggcaaactgggatcgct

SEQ ID NO: 1031 - DNA, 20 bp, Artificial Sequence
  Synthetic primer
tcccacagcaatactccgta

SEQ ID NO: 1032 - DNA, 20 bp, Artificial Sequence
  Synthetic primer
gaaaggcacatttggtgaca

SEQ ID NO: 1033 - DNA, 20 bp, Artificial Sequence
  Synthetic primer
cctggaagctgtagcagaca

SEQ ID NO: 1034 - DNA, 18 bp, Artificial Sequence
  Synthetic primer
acacggtagccggtcact

SEQ ID NO: 1035 - DNA, 20 bp, Artificial Sequence
  Synthetic primer
ccagggtcgacactgctcat

SEQ ID NO: 1036 - DNA, 18 bp, Artificial Sequence
  Synthetic primer
ggagcgggctgtctcaga

SEQ ID NO: 1037 - DNA, 19 bp, Artificial Sequence
  Synthetic primer
atgatccgggaggcatagt

SEQ ID NO: 1038 - DNA, 20 bp, Artificial Sequence
  Synthetic primer
cacatccaaatgcaaactgg

SEQ ID NO: 1039 - DNA, 21 bp, Artificial Sequence
  Synthetic primer
cagcttccttcatggcacact

SEQ ID NO: 1040 - DNA, 18 bp, Artificial Sequence
  Synthetic primer
gcgctgcatgtctaccaa

SEQ ID NO: 1041 - DNA, 23 bp, Artificial Sequence
  Synthetic primer
ggtggttttcttgagcgtgtact

SEQ ID NO: 1042 - DNA, 20 bp, Artificial Sequence
  Synthetic primer
tgggagttcatgggtacaga

SEQ ID NO: 1043 - DNA, 20 bp, Artificial Sequence
  Synthetic primer
ggggtcgtgtttcaacaaat

SEQ ID NO: 1044 - DNA, 26 bp, Artificial Sequence
  Synthetic primer
gagtcagaatggcttattcacagatg

SEQ ID NO: 1045 - DNA, 19 bp, Artificial Sequence
  Synthetic primer
gtagctgcctgggtgctct

SEQ ID NO: 1046 - DNA, 19 bp, Artificial Sequence
  Synthetic primer
ggtcacctcgtcaccaatg

SEQ ID NO: 1047 - DNA, 21 bp, Artificial Sequence
  Synthetic primer
tgaggagtttgccttgattcg

SEQ ID NO: 1048 - DNA, 28 bp, Artificial Sequence
  Synthetic primer
gtcagtgggtctctaataaagagatgag

SEQ ID NO: 1049 - DNA, 22 bp, Artificial Sequence
  Synthetic primer
cacagaatccagctgtgcaact

SEQ ID NO: 1050 - DNA, 19 bp, Artificial Sequence
  Synthetic primer
gtggcaaaacatgagtggg

SEQ ID NO: 1051 - DNA, 23 bp, Artificial Sequence
  Synthetic primer
aaataccaacatgcacctctctt

SEQ ID NO: 1052 - DNA, 18 bp, Artificial Sequence
  Synthetic primer
ggatgctgggaggctctt

SEQ ID NO: 1053 - DNA, 18 bp, Artificial Sequence
  Synthetic primer
tgcgtacccacttcctgc

SEQ ID NO: 1054 - DNA, 20 bp, Artificial Sequence
  Synthetic primer
actccttcatcctcccacag

SEQ ID NO: 1055 - DNA, 23 bp, Artificial Sequence
  Synthetic primer
cgaggttgtgaaaggtgcttatc

SEQ ID NO: 1056 - DNA, 20 bp, Artificial Sequence
  Synthetic primer
aaagttccaggcaacatcgt

SEQ ID NO: 1057 - DNA, 21 bp, Artificial Sequence
  Synthetic primer
ggtccagcagtgtctcctgaa

SEQ ID NO: 1058 - DNA, 18 bp, Artificial Sequence
  Synthetic primer
tggaggcagtgggagatg

SEQ ID NO: 1059 - DNA, 20 bp, Artificial Sequence
  Synthetic primer
agtgcccaggcgtaaacatc

SEQ ID NO: 1060 - DNA, 20 bp, Artificial Sequence
  Synthetic primer
ggccaccagggtattatctg

SEQ ID NO: 1061 - DNA, 20 bp, Artificial Sequence
  Synthetic primer
tcaggaacagccaccagtga

SEQ ID NO: 1062 - DNA, 20 bp, Artificial Sequence
  Synthetic primer
ggcccagcttgaatttttca

SEQ ID NO: 1063 - DNA, 25 bp, Artificial Sequence
  Synthetic primer
gtccactcgaatcttttcttcttca

SEQ ID NO: 1064 - DNA, 23 bp, Artificial Sequence
  Synthetic primer
ggttgtagtcagcgaaggagatc

SEQ ID NO: 1065 - DNA, 21 bp, Artificial Sequence
  Synthetic primer
ggcctcagtgtgcatcattct

SEQ ID NO: 1066 - DNA, 21 bp, Artificial Sequence
  Synthetic primer
tgctttttccgtcagctgtaa

SEQ ID NO: 1067 - DNA, 20 bp, Artificial Sequence
  Synthetic primer
ccacaagtttcatgacaggc

SEQ ID NO: 1068 - DNA, 19 bp, Artificial Sequence
  Synthetic primer
gaacagtggtgctcgttcg

SEQ ID NO: 1069 - DNA, 22 bp, Artificial Sequence
  Synthetic primer
gcttgctgtactccgacatgtt

SEQ ID NO: 1070 - DNA, 19 bp, Artificial Sequence
  Synthetic primer
cttcctgcggccacagtct

SEQ ID NO: 1071 - DNA, 19 bp, Artificial Sequence
  Synthetic primer
cctctcgcaagtgctccat

SEQ ID NO: 1072 - DNA, 19 bp, Artificial Sequence
  Synthetic primer
ttattggtgctccgtggac

SEQ ID NO: 1073 - DNA, 20 bp, Artificial Sequence
  Synthetic primer
cccaaggaatgagtggattt

SEQ ID NO: 1074 - DNA, 18 bp, Artificial Sequence
  Synthetic primer
gcagggagctggagtagc

SEQ ID NO: 1075 - DNA, 28 bp, Artificial Sequence
  Synthetic primer
tgaggttggttactgttggtatcatata

SEQ ID NO: 1076 - DNA, 18 bp, Artificial Sequence
  Synthetic primer
gcatcatagggcctggag

SEQ ID NO: 1077 - DNA, 19 bp, Artificial Sequence
  Synthetic primer
gctcagatactgggggtcc

SEQ ID NO: 1078 - DNA, 20 bp, Artificial Sequence
  Synthetic primer
tgcagaaagagatgccagag

SEQ ID NO: 1079 - DNA, 19 bp, Artificial Sequence
  Synthetic primer
tcggagactcagcaggaaa

SEQ ID NO: 1080 - DNA, 21 bp, Artificial Sequence
  Synthetic primer
tgagcagcaccatcagtaacg

SEQ ID NO: 1081 - DNA, 20 bp, Artificial Sequence
  Synthetic primer
ctcctgatcattccgaaacc

SEQ ID NO: 1082 - DNA, 21 bp, Artificial Sequence
  Synthetic primer
gctggtctcagaaacaccttc

SEQ ID NO: 1083 - DNA, 22 bp, Artificial Sequence
  Synthetic primer
gcttgtcatctgcagcagtgtt

SEQ ID NO: 1084 - DNA, 28 bp, Artificial Sequence
  Synthetic primer
gtttgccaagttaaatttggtacataat

SEQ ID NO: 1085 - DNA, 18 bp, Artificial Sequence
  Synthetic primer
gtcgctcttggcacctct

SEQ ID NO: 1086 - DNA, 20 bp, Artificial Sequence
  Synthetic primer
cgtcgtagtccaccaggatt

SEQ ID NO: 1087 - DNA, 18 bp, Artificial Sequence
  Synthetic primer
ggaactgcccatgcaagt

SEQ ID NO: 1088 - DNA, 19 bp, Artificial Sequence
  Synthetic primer
gaagtgcctgggctttcat

SEQ ID NO: 1089 - DNA, 18 bp, Artificial Sequence
  Synthetic primer
caggttcgctctgggaag

SEQ ID NO: 1090 - DNA, 26 bp, Artificial Sequence
  Synthetic primer
gctacatctacacttggttggcttaa

SEQ ID NO: 1091 - DNA, 19 bp, Artificial Sequence
  Synthetic primer
atgctggctgactctgctc

SEQ ID NO: 1092 - DNA, 19 bp, Artificial Sequence
  Synthetic primer
ctcaatggtgaccaggaca

SEQ ID NO: 1093 - DNA, 18 bp, Artificial Sequence
  Synthetic primer
gcgtggtgctgacggtat

SEQ ID NO: 1094 - DNA, 20 bp, Artificial Sequence
  Synthetic primer
ccaatcaccacatgctcttc

SEQ ID NO: 1095 - DNA, 18 bp, Artificial Sequence
  Synthetic primer
actaagccccgtgagcct

SEQ ID NO: 1096 - DNA, 20 bp, Artificial Sequence
  Synthetic primer
caatggactgcacaaggtca

SEQ ID NO: 1097 - DNA, 22 bp, Artificial Sequence
  Synthetic primer
cttctgagacctctggcttcgt

SEQ ID NO: 1098 - DNA, 20 bp, Artificial Sequence
  Synthetic primer
tgcactcaatggtgaaggac

SEQ ID NO: 1099 - DNA, 19 bp, Artificial Sequence
  Synthetic primer
gagagccattgcagtacac

SEQ ID NO: 1100 - DNA, 21 bp, Artificial Sequence
  Synthetic primer
tccaactgaaggtccctgatg

SEQ ID NO: 1101 - DNA, 22 bp, Artificial Sequence
  Synthetic primer
ggatttccatcttgctcacctt

SEQ ID NO: 1102 - DNA, 20 bp, Artificial Sequence
  Synthetic primer
ctctggctcttcaggccaca

SEQ ID NO: 1103 - DNA, 20 bp, Artificial Sequence
  Synthetic primer
tagaacctcgcaatgacagc

SEQ ID NO: 1104 - DNA, 20 bp, Artificial Sequence
  Synthetic primer
cggacagagcgagctgactt

SEQ ID NO: 1105 - DNA, 30 bp, Artificial Sequence
  Synthetic primer
tttccggtaatagtctgtctcatagatatc

SEQ ID NO: 1106 - DNA, 20 bp, Artificial Sequence
  Synthetic primer
tggactgcttccaggtgtca

SEQ ID NO: 1107 - DNA, 20 bp, Artificial Sequence
  Synthetic primer
ccttcatacccgacttgagg

SEQ ID NO: 1108 - DNA, 18 bp, Artificial Sequence
  Synthetic primer
ccacgcccttgtttcaga

SEQ ID NO: 1109 - DNA, 21 bp, Artificial Sequence
  Synthetic primer
cgaaggtgtggcactgaaagt

SEQ ID NO: 1110 - DNA, 20 bp, Artificial Sequence
  Synthetic primer
gtcttggacacccgcagaat

SEQ ID NO: 1111 - DNA, 19 bp, Artificial Sequence
  Synthetic primer
ctctcctgggcacctgctt

SEQ ID NO: 1112 - DNA, 20 bp, Artificial Sequence
  Synthetic primer
atcaggaaggctgccaagag

SEQ ID NO: 1113 - DNA, 25 bp, Artificial Sequence
  Synthetic primer
tggagcttattaaaggcattcttca

SEQ ID NO: 1114 - DNA, 20 bp, Artificial Sequence
  Synthetic primer
tcttgaccttgcagctttgt

SEQ ID NO: 1115 - DNA, 22 bp, Artificial Sequence
  Synthetic primer
tgagagccagtagtcagtggtt

SEQ ID NO: 1116 - DNA, 20 bp, Artificial Sequence
  Synthetic primer
ggaaagaaggtgctcaggtc

SEQ ID NO: 1117 - DNA, 20 bp, Artificial Sequence
  Synthetic primer
accaggcaagtctcctcatt

SEQ ID NO: 1118 - DNA, 20 bp, Artificial Sequence
  Synthetic primer
aaaattgtgccttggaggag

SEQ ID NO: 1119 - DNA, 20 bp, Artificial Sequence
  Synthetic primer
actgcagagtcagggtctcc

SEQ ID NO: 1120 - DNA, 20 bp, Artificial Sequence
  Synthetic primer
ggcttccagatcgaagtcat

SEQ ID NO: 1121 - DNA, 19 bp, Artificial Sequence
  Synthetic primer
atctccatgacctttgccc

SEQ ID NO: 1122 - DNA, 23 bp, Artificial Sequence
  Synthetic primer
cggtagtggttgatgactgttga

SEQ ID NO: 1123 - DNA, 21 bp, Artificial Sequence
  Synthetic primer
tctccgactgacaggcatttg

SEQ ID NO: 1124 - DNA, 18 bp, Artificial Sequence
  Synthetic primer
gtgatggcaggtgaagcc

SEQ ID NO: 1125 - DNA, 18 bp, Artificial Sequence
  Synthetic primer
atcattgcacggctcacc

SEQ ID NO: 1126 - DNA, 19 bp, Artificial Sequence
  Synthetic primer
gttgctgtcccaaaaagcc

SEQ ID NO: 1127 - DNA, 20 bp, Artificial Sequence
  Synthetic primer
gaagctttgtagccggtgat

SEQ ID NO: 1128 - DNA, 18 bp, Artificial Sequence
  Synthetic primer
gtctggccgggattcttt

SEQ ID NO: 1129 - DNA, 20 bp, Artificial Sequence
  Synthetic primer
gtcttctccacagtccagca

SEQ ID NO: 1130 - DNA, 19 bp, Artificial Sequence
  Synthetic primer
gtttagcctcatgggcgtc

SEQ ID NO: 1131 - DNA, 21 bp, Artificial Sequence
  Synthetic primer
agaacttccattccccaccat

SEQ ID NO: 1132 - DNA, 20 bp, Artificial Sequence
  Synthetic primer
tgccatcaccattgaaatct

SEQ ID NO: 1133 - DNA, 20 bp, Artificial Sequence
  Synthetic primer
cctgagcttagctggtgttg

SEQ ID NO: 1134 - DNA, 27 bp, Artificial Sequence
  Synthetic primer
ccttaagctctttcactgactcaatct

SEQ ID NO: 1135 - DNA, 19 bp, Artificial Sequence
  Synthetic primer
gcgcacaccttcatctcat

SEQ ID NO: 1136 - DNA, 20 bp, Artificial Sequence
  Synthetic primer
ggtgaacatcatgacgcagt

SEQ ID NO: 1137 - DNA, 19 bp, Artificial Sequence
  Synthetic primer
gcatagctgtgagatgcgg

SEQ ID NO: 1138 - DNA, 20 bp, Artificial Sequence
  Synthetic primer
caggaccaccacagagtgag

SEQ ID NO: 1139 - DNA, 20 bp, Artificial Sequence
  Synthetic primer
aggctctggaaacactggtc

SEQ ID NO: 1140 - DNA, 20 bp, Artificial Sequence
  Synthetic primer
aaaaatgcctccacttttgc

SEQ ID NO: 1141 - DNA, 24 bp, Artificial Sequence
  Synthetic primer
ttacaactcttccactgggacgat

SEQ ID NO: 1142 - DNA, 19 bp, Artificial Sequence
  Synthetic primer
ggcatctgagcaagagggt

SEQ ID NO: 1143 - DNA, 18 bp, Artificial Sequence
  Synthetic primer
tcccggtacacctgcttc

SEQ ID NO: 1144 - DNA, 25 bp, Artificial Sequence
  Synthetic primer
gatcagtcaagctgtctgacaattg

SEQ ID NO: 1145 - DNA, 19 bp, Artificial Sequence
  Synthetic primer
ctatgtgcaaggccctcaa

SEQ ID NO: 1146 - DNA, 19 bp, Artificial Sequence
  Synthetic primer
agggtgaggaagacaaccg

SEQ ID NO: 1147 - DNA, 20 bp, Artificial Sequence
  Synthetic primer
atcctggtcctctttgctgt

SEQ ID NO: 1148 - DNA, 19 bp, Artificial Sequence
  Synthetic primer
tgcggtaggtggcaatctc

SEQ ID NO: 1149 - DNA, 20 bp, Artificial Sequence
  Synthetic primer
tgccatatccagaggaaaca

SEQ ID NO: 1150 - DNA, 18 bp, Artificial Sequence
  Synthetic primer
acttggcacgctggttct

SEQ ID NO: 1151 - DNA, 18 bp, Artificial Sequence
  Synthetic primer
tgattgtccgcagtcagg

SEQ ID NO: 1152 - DNA, 20 bp, Artificial Sequence
  Synthetic primer
ttgaaatggcagaacggtag

SEQ ID NO: 1153 - DNA, 20 bp, Artificial Sequence
  Synthetic primer
cagaggatacgctcagcacc

SEQ ID NO: 1154 - DNA, 20 bp, Artificial Sequence
  Synthetic primer
cggcagaactgacagtgttc

SEQ ID NO: 1155 - DNA, 20 bp, Artificial Sequence
  Synthetic primer
gtcacacttgcagcatttca

SEQ ID NO: 1156 - DNA, 21 bp, Artificial Sequence
  Synthetic primer
actccctgaagccgagacact

SEQ ID NO: 1157 - DNA, 20 bp, Artificial Sequence
  Synthetic primer
tgagataggtgggcacttcc

SEQ ID NO: 1158 - DNA, 18 bp, Artificial Sequence
  Synthetic primer
ccagtgcaggggagttgt

SEQ ID NO: 1159 - DNA, 22 bp, Artificial Sequence
  Synthetic primer
taccttggtaaacatgggcttc

SEQ ID NO: 1160 - DNA, 20 bp, Artificial Sequence
  Synthetic primer
cccgcctaagattcttcatt

SEQ ID NO: 1161 - DNA, 20 bp, Artificial Sequence
  Synthetic primer
agaccacaagccatgattga

SEQ ID NO: 1162 - DNA, 20 bp, Artificial Sequence
  Synthetic primer
cttgagggtttgggtttcca

SEQ ID NO: 1163 - DNA, 19 bp, Artificial Sequence
  Synthetic primer
gacagctgcacagagccat

SEQ ID NO: 1164 - DNA, 20 bp, Artificial Sequence
  Synthetic primer
aagagctgcccatccttctc

SEQ ID NO: 1165 - DNA, 21 bp, Artificial Sequence
  Synthetic primer
ccccacgagttctggttcttc

SEQ ID NO: 1166 - DNA, 18 bp, Artificial Sequence
  Synthetic primer
ctcaggcagtcctcgtgc

SEQ ID NO: 1167 - DNA, 19 bp, Artificial Sequence
  Synthetic primer
cgctgaggctggtactgtg

SEQ ID NO: 1168 - DNA, 20 bp, Artificial Sequence
  Synthetic primer
gagacaaagaggccatccag

SEQ ID NO: 1169 - DNA, 20 bp, Artificial Sequence
  Synthetic primer
ggtcaggttattgctgctga

SEQ ID NO: 1170 - DNA, 19 bp, Artificial Sequence
  Synthetic primer
agacaccacggcatgattc

SEQ ID NO: 1171 - DNA, 20 bp, Artificial Sequence
  Synthetic primer
acccatgctctaatgccttg

SEQ ID NO: 1172 - DNA, 23 bp, Artificial Sequence
  Synthetic primer
atcccagcagtctcttcacaact

SEQ ID NO: 1173 - DNA, 23 bp, Artificial Sequence
  Synthetic primer
accaatactcaggagcaggatga

SEQ ID NO: 1174 - DNA, 20 bp, Artificial Sequence
  Synthetic primer
cacaaacaggaggtgaccct

SEQ ID NO: 1175 - DNA, 19 bp, Artificial Sequence
  Synthetic primer
ggaacattggaggaggcaa

SEQ ID NO: 1176 - DNA, 19 bp, Artificial Sequence
  Synthetic primer
cagcccccagctcactgat

SEQ ID NO: 1177 - DNA, 21 bp, Artificial Sequence
  Synthetic primer
gtagccactgatgccaaagtc

SEQ ID NO: 1178 - DNA, 23 bp, Artificial Sequence
  Synthetic primer
gcagcatacacacaacaaaatgg

SEQ ID NO: 1179 - DNA, 18 bp, Artificial Sequence
  Synthetic primer
cggtcttggagaactggg

SEQ ID NO: 1180 - DNA, 22 bp, Artificial Sequence
  Synthetic primer
ggcagcattaaccacaaggatt

SEQ ID NO: 1181 - DNA, 18 bp, Artificial Sequence
  Synthetic primer
tgcaactgaagcacaggc

SEQ ID NO: 1182 - DNA, 26 bp, Artificial Sequence
  Synthetic primer
gccactaactgcttcagtatgaagag

SEQ ID NO: 1183 - DNA, 20 bp, Artificial Sequence
  Synthetic primer
atctcctggatggtgatggt

SEQ ID NO: 1184 - DNA, 20 bp, Artificial Sequence
  Synthetic primer
tgggacaggaaacacaccaa

SEQ ID NO: 1185 - DNA, 25 bp, Artificial Sequence
  Synthetic primer
gcactgagatcttcctattggtgaa

SEQ ID NO: 1186 - DNA, 20 bp, Artificial Sequence
  Synthetic primer
caatgacagggacgttgact

SEQ ID NO: 1187 - DNA, 18 bp, Artificial Sequence
  Synthetic primer
gactttggtgcctgtgcc

SEQ ID NO: 1188 - DNA, 23 bp, Artificial Sequence
  Synthetic primer
atccaaccaatcacctgaatgtt

SEQ ID NO: 1189 - DNA, 20 bp, Artificial Sequence
  Synthetic primer
gaccctgctcacaaccagac

SEQ ID NO: 1190 - DNA, 26 bp, Artificial Sequence
  Synthetic primer
tccatatccaacaaaaaaactcaaag

SEQ ID NO: 1191 - DNA, 18 bp, Artificial Sequence
  Synthetic primer
aagccagaagccctgcat

SEQ ID NO: 1192 - DNA, 18 bp, Artificial Sequence
  Synthetic primer
ggtggagttgttccagcc

SEQ ID NO: 1193 - DNA, 19 bp, Artificial Sequence
  Synthetic primer
gggcctggttgaaaagcat

SEQ ID NO: 1194 - DNA, 23 bp, Artificial Sequence
  Synthetic primer
tgaatgccattcacatcatcttg

SEQ ID NO: 1195 - DNA, 18 bp, Artificial Sequence
  Synthetic primer
agcaaggacagggaccaa

SEQ ID NO: 1196 - DNA, 21 bp, Artificial Sequence
  Synthetic primer
ggagtccgtccttaccgtcaa

SEQ ID NO: 1197 - DNA, 22 bp, Artificial Sequence
  Synthetic primer
ggaatgtcccatacccaaagaa

SEQ ID NO: 1198 - DNA, 20 bp, Artificial Sequence
  Synthetic primer
cacccgagtgtaaccatagc

SEQ ID NO: 1199 - DNA, 23 bp, Artificial Sequence
  Synthetic primer
cgattgtctttgctcttcatgtg

SEQ ID NO: 1200 - DNA, 20 bp, Artificial Sequence
  Synthetic primer
aaaactgcatggctttgtca

SEQ ID NO: 1201 - DNA, 20 bp, Artificial Sequence
  Synthetic primer
ccgttgagtggaatcagcaa

SEQ ID NO: 1202 - DNA, 20 bp, Artificial Sequence
  Synthetic primer
agagcccctggagagaagat

SEQ ID NO: 1203 - DNA, 20 bp, Artificial Sequence
  Synthetic primer
tcttggcaagtcggttaaga

SEQ ID NO: 1204 - DNA, 20 bp, Artificial Sequence
  Synthetic primer
cttgtgaaaatgccatccac

SEQ ID NO: 1205 - DNA, 20 bp, Artificial Sequence
  Synthetic primer
caaattgcgagtggtgaaat

SEQ ID NO: 1206 - DNA, 18 bp, Artificial Sequence
  Synthetic primer
acagcagcggcacttctc

SEQ ID NO: 1207 - DNA, 18 bp, Artificial Sequence
  Synthetic primer
agcagttggggtccattg

SEQ ID NO: 1208 - DNA, 18 bp, Artificial Sequence
  Synthetic primer
agcagttggggtccattg

SEQ ID NO: 1209 - DNA, 18 bp, Artificial Sequence
  Synthetic primer
acttggcacagcccacag

SEQ ID NO: 1210 - DNA, 20 bp, Artificial Sequence
  Synthetic primer
ctccacgtcgtggacattga

SEQ ID NO: 1211 - DNA, 22 bp, Artificial Sequence
  Synthetic primer
gcatgtaggtgcttccaatcac

SEQ ID NO: 1212 - DNA, 26 bp, Artificial Sequence
  Synthetic primer
gtctattagagtcagatccgggacat

SEQ ID NO: 1213 - DNA, 27 bp, Artificial Sequence
  Synthetic primer
cttttgatggtagagttccagtgattc

SEQ ID NO: 1214 - DNA, 21 bp, Artificial Sequence
  Synthetic primer
ccgagtagatgggcaggtgtt

SEQ ID NO: 1215 - DNA, 20 bp, Artificial Sequence
  Synthetic primer
agcagctcttgcagacattg

SEQ ID NO: 1216 - DNA, 18 bp, Artificial Sequence
  Synthetic primer
tcccttgcagctggagtt

SEQ ID NO: 1217 - DNA, 19 bp, Artificial Sequence
  Synthetic primer
atagtgctggctgggtacg

SEQ ID NO: 1218 - DNA, 18 bp, Artificial Sequence
  Synthetic primer
aggaaacgatggcgaggt

SEQ ID NO: 1219 - DNA, 18 bp, Artificial Sequence
  Synthetic primer
ctttggctcgtggcattc

SEQ ID NO: 1220 - DNA, 18 bp, Artificial Sequence
  Synthetic primer
agctgccagtgctatccg

SEQ ID NO: 1221 - DNA, 22 bp, Artificial Sequence
  Synthetic primer
ccaggttctggaaactgtggat

SEQ ID NO: 1222 - DNA, 21 bp, Artificial Sequence
  Synthetic primer
cgtccacattcacactgtagc

SEQ ID NO: 1223 - DNA, 20 bp, Artificial Sequence
  Synthetic primer
ctgaatgcagaagtccccac

SEQ ID NO: 1224 - DNA, 20 bp, Artificial Sequence
  Synthetic primer
ctagtccagccaaacatccc

SEQ ID NO: 1225 - DNA, 20 bp, Artificial Sequence
  Synthetic primer
atgatgtgtgtggcctttgt

SEQ ID NO: 1226 - DNA, 19 bp, Artificial Sequence
  Synthetic primer
gctcatctggaggggtagg

SEQ ID NO: 1227 - DNA, 21 bp, Artificial Sequence
  Synthetic primer
tcggagccatacaggattgtc

SEQ ID NO: 1228 - DNA, 21 bp, Artificial Sequence
  Synthetic primer
gttgtattggttcggcaccat

SEQ ID NO: 1229 - DNA, 20 bp, Artificial Sequence
  Synthetic primer
agttgtcaaacaggcactcg

SEQ ID NO: 1230 - DNA, 18 bp, Artificial Sequence
  Synthetic primer
actccctgccaggttggt

SEQ ID NO: 1231 - DNA, 21 bp, Artificial Sequence
  Synthetic primer
ggagcattcgaggtcaaatca

SEQ ID NO: 1232 - DNA, 19 bp, Artificial Sequence
  Synthetic primer
caagcaaagggtggagttc

SEQ ID NO: 1233 - DNA, 19 bp, Artificial Sequence
  Synthetic primer
tgagtcacttcaaaggcgg

SEQ ID NO: 1234 - DNA, 18 bp, Artificial Sequence
  Synthetic primer
cacacaagccagcttcca

SEQ ID NO: 1235 - DNA, 19 bp, Artificial Sequence
  Synthetic primer
ttgtctttttcgctcctgc

SEQ ID NO: 1236 - DNA, 22 bp, Artificial Sequence
  Synthetic primer
cttggcgtgtggaaatctacag

SEQ ID NO: 1237 - DNA, 19 bp, Artificial Sequence
  Synthetic primer
gtccaggatggtgtcctga

SEQ ID NO: 1238 - DNA, 18 bp, Artificial Sequence
  Synthetic primer
atatggacatccacgggc

SEQ ID NO: 1239 - DNA, 25 bp, Artificial Sequence
  Synthetic primer
cctcagtccataaaccacactatca

SEQ ID NO: 1240 - DNA, 22 bp, Artificial Sequence
  Synthetic primer
ggcgtttggagtggtagaaatc

SEQ ID NO: 1241 - DNA, 19 bp, Artificial Sequence
  Synthetic primer
ggctcgcctcttccatgtc

SEQ ID NO: 1242 - DNA, 18 bp, Artificial Sequence
  Synthetic primer
cccgggacaaagcaaatg

SEQ ID NO: 1243 - DNA, 22 bp, Artificial Sequence
  Synthetic primer
cacattctgtccatggctttac

SEQ ID NO: 1244 - DNA, 21 bp, Artificial Sequence
  Synthetic primer
tgctgggtttctcctcctgtt

SEQ ID NO: 1245 - DNA, 20 bp, Artificial Sequence
  Synthetic primer
ccatgcaagtttctgtcacc

SEQ ID NO: 1246 - DNA, 20 bp, Artificial Sequence
  Synthetic primer
accatcatgtccgtcacttg

SEQ ID NO: 1247 - DNA, 20 bp, Artificial Sequence
  Synthetic primer
ggctgggcttaaacagtcat

SEQ ID NO: 1248 - DNA, 18 bp, Artificial Sequence
  Synthetic primer
attccagctccacgagca

SEQ ID NO: 1249 - DNA, 19 bp, Artificial Sequence
  Synthetic primer
cttccggaaccagttgaca

SEQ ID NO: 1250 - DNA, 21 bp, Artificial Sequence
  Synthetic primer
ggtttacaccgctggagctaa

SEQ ID NO: 1251 - DNA, 19 bp, Artificial Sequence
  Synthetic primer
gttgctggagccatttcac

SEQ ID NO: 1252 - DNA, 18 bp, Artificial Sequence
  Synthetic primer
ggctcatgcggtaccagt

SEQ ID NO: 1253 - DNA, 20 bp, Artificial Sequence
  Synthetic primer
agcttcattggaggagagga

SEQ ID NO: 1254 - DNA, 21 bp, Artificial Sequence
  Synthetic primer
tgggttctgtccaaacactgg

SEQ ID NO: 1255 - DNA, 20 bp, Artificial Sequence
  Synthetic primer
taaataaccctgcccacaca

SEQ ID NO: 1256 - DNA, 21 bp, Artificial Sequence
  Synthetic primer
gtcggtgagtgatttgtgcaa

SEQ ID NO: 1257 - DNA, 20 bp, Artificial Sequence
  Synthetic primer
taacgcttggcatcatcatt

SEQ ID NO: 1258 - DNA, 20 bp, Artificial Sequence
  Synthetic primer
cttcaaccaccttcccaaac

SEQ ID NO: 1259 - DNA, 20 bp, Artificial Sequence
  Synthetic primer
gggtggctctcacttagctc

SEQ ID NO: 1260 - DNA, 20 bp, Artificial Sequence
  Synthetic primer
cgcaggaagaagccatagtt

SEQ ID NO: 1261 - DNA, 18 bp, Artificial Sequence
  Synthetic primer
ctcggccctgctgagtaa

SEQ ID NO: 1262 - DNA, 18 bp, Artificial Sequence
  Synthetic primer
ggccttgatcacctccag

SEQ ID NO: 1263 - DNA, 18 bp, Artificial Sequence
  Synthetic primer
ggtgctccacgttggact

SEQ ID NO: 1264 - DNA, 19 bp, Artificial Sequence
  Synthetic primer
gccgacagccacattgtat

SEQ ID NO: 1265 - DNA, 19 bp, Artificial Sequence
  Synthetic primer
agcaagggaacagcctcat

SEQ ID NO: 1266 - DNA, 20 bp, Artificial Sequence
  Synthetic primer
aggccgtccttcagtaacca

SEQ ID NO: 1267 - DNA, 23 bp, Artificial Sequence
  Synthetic primer
cacactagcattttctccgcata

SEQ ID NO: 1268 - DNA, 18 bp, Artificial Sequence
  Synthetic primer
gtcctgcgtgggaatagc

SEQ ID NO: 1269 - DNA, 18 bp, Artificial Sequence
  Synthetic primer
aggatgtagcagctggcg

SEQ ID NO: 1270 - DNA, 18 bp, Artificial Sequence
  Synthetic primer
tagctgatgccctggtcc

SEQ ID NO: 1271 - DNA, 20 bp, Artificial Sequence
  Synthetic primer
ccggtggctaccagacattg

SEQ ID NO: 1272 - DNA, 20 bp, Artificial Sequence
  Synthetic primer
atgtatccatgagcgtgtgg

SEQ ID NO: 1273 - DNA, 19 bp, Artificial Sequence
  Synthetic primer
cctgtctgcatgggatgac

SEQ ID NO: 1274 - DNA, 19 bp, Artificial Sequence
  Synthetic primer
tctcccaggatgcatgaag

SEQ ID NO: 1275 - DNA, 19 bp, Artificial Sequence
  Synthetic primer
cagagggccatctcaggtt

SEQ ID NO: 1276 - DNA, 19 bp, Artificial Sequence
  Synthetic primer
tgtaggcgaaaccgtagga

SEQ ID NO: 1277 - DNA, 22 bp, Artificial Sequence
  Synthetic primer
cacgaagaaaactatgcagcag

SEQ ID NO: 1278 - DNA, 20 bp, Artificial Sequence
  Synthetic primer
gccaagtcgctgtcatctaa

SEQ ID NO: 1279 - DNA, 20 bp, Artificial Sequence
  Synthetic primer
cacagctttccatcaccatc

SEQ ID NO: 1280 - DNA, 18 bp, Artificial Sequence
  Synthetic primer
atgtggctcgcctctacg

SEQ ID NO: 1281 - DNA, 19 bp, Artificial Sequence
  Synthetic primer
cagggagagaagcgaacaa

SEQ ID NO: 1282 - DNA, 20 bp, Artificial Sequence
  Synthetic primer
gtaaatccgccccctcttct

SEQ ID NO: 1283 - DNA, 20 bp, Artificial Sequence
  Synthetic primer
cccattcacgtactccatca

SEQ ID NO: 1284 - DNA, 20 bp, Artificial Sequence
  Synthetic primer
aggtggtccttggtctggaa

SEQ ID NO: 1285 - DNA, 20 bp, Artificial Sequence
  Synthetic primer
cacactttccctccttttgg

SEQ ID NO: 1286 - DNA, 20 bp, Artificial Sequence
  Synthetic primer
tcggtatcttggtcttgcag

SEQ ID NO: 1287 - DNA, 20 bp, Artificial Sequence
  Synthetic primer
ctccaaccatgaggaagacg

SEQ ID NO: 1288 - DNA, 19 bp, Artificial Sequence
  Synthetic primer
ccatgctggtcttcaccac

SEQ ID NO: 1289 - DNA, 20 bp, Artificial Sequence
  Synthetic primer
attgtgtgtccttcggattg

SEQ ID NO: 1290 - DNA, 18 bp, Artificial Sequence
  Synthetic primer
ccacacgaggctggagtt

SEQ ID NO: 1291 - DNA, 18 bp, Artificial Sequence
  Synthetic primer
aggccatgcagacgttgt

SEQ ID NO: 1292 - DNA, 18 bp, Artificial Sequence
  Synthetic primer
taagcaatagccctgcgg

SEQ ID NO: 1293 - DNA, 19 bp, Artificial Sequence
  Synthetic primer
cattgcccaagatgactcg

SEQ ID NO: 1294 - DNA, 25 bp, Artificial Sequence
  Synthetic primer
tgcacatatcattacaccagttcgt

SEQ ID NO: 1295 - DNA, 19 bp, Artificial Sequence
  Synthetic primer
gcccatgggatgagaaact

SEQ ID NO: 1296 - DNA, 18 bp, Artificial Sequence
  Synthetic primer
gcgtgcctttcgcttgaa

SEQ ID NO: 1297 - DNA, 20 bp, Artificial Sequence
  Synthetic primer
ctggacatctcgatgacagc

SEQ ID NO: 1298 - DNA, 21 bp, Artificial Sequence
  Synthetic primer
gaacctggaactgcagctttg

SEQ ID NO: 1299 - DNA, 20 bp, Artificial Sequence
  Synthetic primer
cccctctctccactttggat

SEQ ID NO: 1300 - DNA, 23 bp, Artificial Sequence
  Synthetic primer
tttcaagattgcacgtttcacat

SEQ ID NO: 1301 - DNA, 20 bp, Artificial Sequence
  Synthetic primer
ctggccacaccgtatagtga

SEQ ID NO: 1302 - DNA, 21 bp, Artificial Sequence
  Synthetic primer
ggacatcttttgtgctggttg

SEQ ID NO: 1303 - DNA, 20 bp, Artificial Sequence
  Synthetic primer
ggactcggaacaggtaaagg

SEQ ID NO: 1304 - DNA, 20 bp, Artificial Sequence
  Synthetic primer
gcttcagcccatccttagca

SEQ ID NO: 1305 - DNA, 19 bp, Artificial Sequence
  Synthetic primer
cagccaccagagtggagaa

SEQ ID NO: 1306 - DNA, 19 bp, Artificial Sequence
  Synthetic primer
acccacgatcttcctggtc

SEQ ID NO: 1307 - DNA, 20 bp, Artificial Sequence
  Synthetic primer
ttgagcaaagcgtacaaagg

SEQ ID NO: 1308 - DNA, 18 bp, Artificial Sequence
  Synthetic primer
agcatccgcagaaacctg

SEQ ID NO: 1309 - DNA, 20 bp, Artificial Sequence
  Synthetic primer
tgaaggcgtgaggtgtagaa

SEQ ID NO: 1310 - DNA, 24 bp, Artificial Sequence
  Synthetic primer
ttcgatattgccagcagctataaa

SEQ ID NO: 1311 - DNA, 20 bp, Artificial Sequence
  Synthetic primer
aaggccgtctgagaaagtca

SEQ ID NO: 1312 - DNA, 19 bp, Artificial Sequence
  Synthetic primer
aaagagtgcaaacttgcgg

SEQ ID NO: 1313 - DNA, 20 bp, Artificial Sequence
  Synthetic primer
ggactcttcaggggtgaaat

SEQ ID NO: 1314 - DNA, 21 bp, Artificial Sequence
  Synthetic primer
ctctgtccgcagacttcatct

SEQ ID NO: 1315 - DNA, 20 bp, Artificial Sequence
  Synthetic primer
tgctaggtttcccctctgaa

SEQ ID NO: 1316 - DNA, 18 bp, Artificial Sequence
  Synthetic primer
ggaagggcagaccctcac

SEQ ID NO: 1317 - DNA, 20 bp, Artificial Sequence
  Synthetic primer
ctcgagtgcggaagtcaata

SEQ ID NO: 1318 - DNA, 22 bp, Artificial Sequence
  Synthetic primer
gaaggttccaccaggttcttca

SEQ ID NO: 1319 - DNA, 20 bp, Artificial Sequence
  Synthetic primer
gctcccaagactctgacaca

SEQ ID NO: 1320 - DNA, 18 bp, Artificial Sequence
  Synthetic primer
cctccccaagtcagttgc

SEQ ID NO: 1321 - DNA, 22 bp, Artificial Sequence
  Synthetic primer
gagcactcaaggtagccaaagg

SEQ ID NO: 1322 - DNA, 19 bp, Artificial Sequence
  Synthetic primer
aagtccctgggaactgtgc

SEQ ID NO: 1323 - DNA, 20 bp, Artificial Sequence
  Synthetic primer
ctggttactcccctccaaca

SEQ ID NO: 1324 - DNA, 20 bp, Artificial Sequence
  Synthetic primer
gtttagcacgcaattgctca

SEQ ID NO: 1325 - DNA, 21 bp, Artificial Sequence
  Synthetic primer
aggaccaaggaatttaagcca

SEQ ID NO: 1326 - DNA, 18 bp, Artificial Sequence
  Synthetic primer
gtcgccggatgaagtgag

SEQ ID NO: 1327 - DNA, 19 bp, Artificial Sequence
  Synthetic primer
ccttaaagcggactccagg

SEQ ID NO: 1328 - DNA, 20 bp, Artificial Sequence
  Synthetic primer
tcctggatcttggcctttac

SEQ ID NO: 1329 - DNA, 19 bp, Artificial Sequence
  Synthetic primer
cggctgaagtccagcttct

SEQ ID NO: 1330 - DNA, 26 bp, Artificial Sequence
  Synthetic primer
aagaaacagaagttgtctggctttct

SEQ ID NO: 1331 - DNA, 20 bp, Artificial Sequence
  Synthetic primer
ctctcagcatcggtacaagg

SEQ ID NO: 1332 - DNA, 20 bp, Artificial Sequence
  Synthetic primer
atctgcgttgaagcagtgag

SEQ ID NO: 1333 - DNA, 21 bp, Artificial Sequence
  Synthetic primer
gtgatttgcccaggaaagttt

SEQ ID NO: 1334 - DNA, 20 bp, Artificial Sequence
  Synthetic primer
agcaccacatactcctggaa

SEQ ID NO: 1335 - DNA, 20 bp, Artificial Sequence
  Synthetic primer
tttatccccagcgaatttgt

SEQ ID NO: 1336 - DNA, 22 bp, Artificial Sequence
  Synthetic primer
tcccccttactcagcttgaact

SEQ ID NO: 1337 - DNA, 20 bp, Artificial Sequence
  Synthetic primer
tgctgacactcaggaccaag

SEQ ID NO: 1338 - DNA, 19 bp, Artificial Sequence
  Synthetic primer
gtggcccaattccccaagt

SEQ ID NO: 1339 - DNA, 18 bp, Artificial Sequence
  Synthetic primer
gaagttgcccagcgtgtc

SEQ ID NO: 1340 - DNA, 19 bp, Artificial Sequence
  Synthetic primer
ccctttccaaacttgaggc

SEQ ID NO: 1341 - DNA, 19 bp, Artificial Sequence
  Synthetic primer
ggtcattctggatgccctt

SEQ ID NO: 1342 - DNA, 21 bp, Artificial Sequence
  Synthetic primer
aaagtccagctaccaagggaa

SEQ ID NO: 1343 - DNA, 21 bp, Artificial Sequence
  Synthetic primer
ccatctcgtaagacattggga

SEQ ID NO: 1344 - DNA, 19 bp, Artificial Sequence
  Synthetic primer
cctccaaaggctcacactg

SEQ ID NO: 1345 - DNA, 20 bp, Artificial Sequence
  Synthetic primer
gtaattacgcacggggtaca

SEQ ID NO: 1346 - DNA, 21 bp, Artificial Sequence
  Synthetic primer
acgtggagaagacggcataga

SEQ ID NO: 1347 - DNA, 21 bp, Artificial Sequence
  Synthetic primer
gtctcacatcttgtcttcggc

SEQ ID NO: 1348 - DNA, 19 bp, Artificial Sequence
  Synthetic primer
cactcgccgttgacatcct

SEQ ID NO: 1349 - DNA, 18 bp, Artificial Sequence
  Synthetic primer
tcacattccgcacaggac

SEQ ID NO: 1350 - DNA, 19 bp, Artificial Sequence
  Synthetic primer
ctttgtggcactgagctgg

SEQ ID NO: 1351 - DNA, 19 bp, Artificial Sequence
  Synthetic primer
aggctgccatgtcctcata

SEQ ID NO: 1352 - DNA, 18 bp, Artificial Sequence
  Synthetic primer
tgaagtcatccttggccc

SEQ ID NO: 1353 - DNA, 20 bp, Artificial Sequence
  Synthetic primer
ggacatccctgttagctcca

SEQ ID NO: 1354 - DNA, 20 bp, Artificial Sequence
  Synthetic primer
ctgttatcccaacccaaacc

SEQ ID NO: 1355 - DNA, 18 bp, Artificial Sequence
  Synthetic primer
actcagacctgctgccca

SEQ ID NO: 1356 - DNA, 18 bp, Artificial Sequence
  Synthetic primer
ctatcggcctcagcatgg

SEQ ID NO: 1357 - DNA, 19 bp, Artificial Sequence
  Synthetic primer
agcccactgaggaagagga

SEQ ID NO: 1358 - DNA, 19 bp, Artificial Sequence
  Synthetic primer
aatcagggaggaggtgagc

SEQ ID NO: 1359 - DNA, 18 bp, Artificial Sequence
  Synthetic primer
caggatggcttgggtgag

SEQ ID NO: 1360 - DNA, 22 bp, Artificial Sequence
  Synthetic primer
gaccagcccatagtatgcaaag

SEQ ID NO: 1361 - DNA, 19 bp, Artificial Sequence
  Synthetic primer
agtctccaccctcaggcat

SEQ ID NO: 1362 - DNA, 20 bp, Artificial Sequence
  Synthetic primer
agcctctctccgtaggacaa

SEQ ID NO: 1363 - DNA, 18 bp, Artificial Sequence
  Synthetic primer
agctgagctgtgggttgc

SEQ ID NO: 1364 - DNA, 20 bp, Artificial Sequence
  Synthetic primer
agtggggatcacatggaaac

SEQ ID NO: 1365 - DNA, 18 bp, Artificial Sequence
  Synthetic primer
atgcaggcatgaattggg

SEQ ID NO: 1366 - DNA, 20 bp, Artificial Sequence
  Synthetic primer
gtagggctgctggaaggtaa

SEQ ID NO: 1367 - DNA, 19 bp, Artificial Sequence
  Synthetic primer
gccggctttcagaatcatc

SEQ ID NO: 1368 - DNA, 20 bp, Artificial Sequence
  Synthetic primer
aatagacacatcggccacac

SEQ ID NO: 1369 - DNA, 20 bp, Artificial Sequence
  Synthetic primer
ccatggattgtctgtggtgt

SEQ ID NO: 1370 - DNA, 20 bp, Artificial Sequence
  Synthetic primer
agctcggtgtgggagaggta

SEQ ID NO: 1371 - DNA, 19 bp, Artificial Sequence
  Synthetic primer
gattgagctctctcggcct

SEQ ID NO: 1372 - DNA, 19 bp, Artificial Sequence
  Synthetic primer
attcccaggtggaccaaag

SEQ ID NO: 1373 - DNA, 20 bp, Artificial Sequence
  Synthetic primer
gcagttggtcaggaggtctt

SEQ ID NO: 1374 - DNA, 24 bp, Artificial Sequence
  Synthetic primer
ccttcaagtcatccacaatcagtt

SEQ ID NO: 1375 - DNA, 18 bp, Artificial Sequence
  Synthetic primer
gggtccagagagcttggc

SEQ ID NO: 1376 - DNA, 20 bp, Artificial Sequence
  Synthetic primer
acatgttcagctggtccaca

SEQ ID NO: 1377 - DNA, 20 bp, Artificial Sequence
  Synthetic primer
cttgcaggaagcggctatac

SEQ ID NO: 1378 - DNA, 20 bp, Artificial Sequence
  Synthetic primer
gccaggaacacgaggttctc

SEQ ID NO: 1379 - DNA, 21 bp, Artificial Sequence
  Synthetic primer
gcaaaagcattgtcccagaga

SEQ ID NO: 1380 - DNA, 19 bp, Artificial Sequence
  Synthetic primer
agatggagcacaggcttcc

SEQ ID NO: 1381 - DNA, 20 bp, Artificial Sequence
  Synthetic primer
gggatccttcgcaacttctt

SEQ ID NO: 1382 - DNA, 20 bp, Artificial Sequence
  Synthetic primer
tccgaccttcaatcatttca

SEQ ID NO: 1383 - DNA, 19 bp, Artificial Sequence
  Synthetic primer
ctgaggtgcaacccagtca

SEQ ID NO: 1384 - DNA, 23 bp, Artificial Sequence
  Synthetic primer
tacaatggctttggaggatagca

SEQ ID NO: 1385 - DNA, 18 bp, Artificial Sequence
  Synthetic primer
cggcatgacccattcttc

SEQ ID NO: 1386 - DNA, 21 bp, Artificial Sequence
  Synthetic primer
agcactgtttcatccaccttc

SEQ ID NO: 1387 - DNA, 24 bp, Artificial Sequence
  Synthetic primer
caaagctgtcagctctagcaaaag

SEQ ID NO: 1388 - DNA, 20 bp, Artificial Sequence
  Synthetic primer
aagctcggttcctttctcaa

SEQ ID NO: 1389 - DNA, 25 bp, Artificial Sequence
  Synthetic primer
agtctggaacatgtcagtcttgatg

SEQ ID NO: 1390 - DNA, 18 bp, Artificial Sequence
  Synthetic primer
tcccactgcttacagccc

SEQ ID NO: 1391 - DNA, 19 bp, Artificial Sequence
  Synthetic primer
atgtggcaacttggaccct

SEQ ID NO: 1392 - DNA, 20 bp, Artificial Sequence
  Synthetic primer
caccacattggttctgatgc

SEQ ID NO: 1393 - DNA, 19 bp, Artificial Sequence
  Synthetic primer
cctgggccttggtgttgac

SEQ ID NO: 1394 - DNA, 24 bp, Artificial Sequence
  Synthetic primer
gaggtgtcaccaacaagaaatcat

SEQ ID NO: 1395 - DNA, 18 bp, Artificial Sequence
  Synthetic primer
ccacacgctctcaggacc

SEQ ID NO: 1396 - DNA, 20 bp, Artificial Sequence
  Synthetic primer
ctgtctgatcgtgcagcaac

SEQ ID NO: 1397 - DNA, 19 bp, Artificial Sequence
  Synthetic primer
ttgcggagtcagggagtta

SEQ ID NO: 1398 - DNA, 24 bp, Artificial Sequence
  Synthetic primer
acggagttcttgacagagttttga

SEQ ID NO: 1399 - DNA, 20 bp, Artificial Sequence
  Synthetic primer
tgacacagagatccgcagtc

SEQ ID NO: 1400 - DNA, 20 bp, Artificial Sequence
  Synthetic primer
cctggtgctgttgtagatgg

SEQ ID NO: 1401 - DNA, 19 bp, Artificial Sequence
  Synthetic primer
agtggtagggctgctggac

SEQ ID NO: 1402 - DNA, 19 bp, Artificial Sequence
  Synthetic primer
gcagacgaagcacactggt

SEQ ID NO: 1403 - DNA, 20 bp, Artificial Sequence
  Synthetic primer
cctcttcatcaggccaaact

SEQ ID NO: 1404 - DNA, 18 bp, Artificial Sequence
  Synthetic primer
ggaaatgacatcggcagc

SEQ ID NO: 1405 - DNA, 27 bp, Artificial Sequence
  Synthetic primer
gtactgaactccgttgtgatagcatag

SEQ ID NO: 1406 - DNA, 20 bp, Artificial Sequence
  Synthetic primer
gtgggaacagggtggacact

SEQ ID NO: 1407 - DNA, 22 bp, Artificial Sequence
  Synthetic primer
tgtggttcaggctcttcttctg

SEQ ID NO: 1408 - DNA, 20 bp, Artificial Sequence
  Synthetic primer
accgaaattggagagcatgt

SEQ ID NO: 1409 - DNA, 18 bp, Artificial Sequence
  Synthetic primer
cagcggcaccaggttcag

SEQ ID NO: 1410 - DNA, 18 bp, Artificial Sequence
  Synthetic primer
ccattcctggcctgtgag

SEQ ID NO: 1411 - DNA, 20 bp, Artificial Sequence
  Synthetic primer
tctgcacctggttgacagag

SEQ ID NO: 1412 - DNA, 21 bp, Artificial Sequence
  Synthetic primer
gcaaataaccaacagccaatg

SEQ ID NO: 1413 - DNA, 19 bp, Artificial Sequence
  Synthetic primer
gtcggcagggtgttcttct

SEQ ID NO: 1414 - DNA, 18 bp, Artificial Sequence
  Synthetic primer
tgcccagactcggcaaag

SEQ ID NO: 1415 - DNA, 19 bp, Artificial Sequence
  Synthetic primer
gtggaatggctctggcttc

SEQ ID NO: 1416 - DNA, 20 bp, Artificial Sequence
  Synthetic primer
ctgtaaagacgccaccacac

SEQ ID NO: 1417 - DNA, 19 bp, Artificial Sequence
  Synthetic primer
ctctgtccccagagttccc

SEQ ID NO: 1418 - DNA, 20 bp, Artificial Sequence
  Synthetic primer
gctcaggaatctctgcccta

SEQ ID NO: 1419 - DNA, 22 bp, Artificial Sequence
  Synthetic primer
gggaaagtggtacgtctttgag

SEQ ID NO: 1420 - DNA, 18 bp, Artificial Sequence
  Synthetic primer
gtcaggcacggtggagag

SEQ ID NO: 1421 - DNA, 20 bp, Artificial Sequence
  Synthetic primer
cacagggaattctcaaggga

SEQ ID NO: 1422 - DNA, 22 bp, Artificial Sequence
  Synthetic primer
tcgaaacaaagtcaccagactc

SEQ ID NO: 1423 - DNA, 20 bp, Artificial Sequence
  Synthetic primer
acccactgcactccaaagaa

SEQ ID NO: 1424 - DNA, 19 bp, Artificial Sequence
  Synthetic primer
gcgaccttttcctccagtt

SEQ ID NO: 1425 - DNA, 20 bp, Artificial Sequence
  Synthetic primer
gtacagattttgcccgagga

SEQ ID NO: 1426 - DNA, 18 bp, Artificial Sequence
  Synthetic primer
ctagcccgaccggttcgt

SEQ ID NO: 1427 - DNA, 24 bp, Artificial Sequence
  Synthetic primer
ccacgagtttcttactgagaatgg

SEQ ID NO: 1428 - DNA, 21 bp, Artificial Sequence
  Synthetic primer
catctgcttcagctcgttggt

SEQ ID NO: 1429 - DNA, 19 bp, Artificial Sequence
  Synthetic primer
cgtgatgtgcgcaatcatg

SEQ ID NO: 1430 - DNA, 20 bp, Artificial Sequence
  Synthetic primer
gtgtcagcataagggctggt

SEQ ID NO: 1431 - DNA, 18 bp, Artificial Sequence
  Synthetic primer
caggaaacgctcctgtgc

SEQ ID NO: 1432 - DNA, 21 bp, Artificial Sequence
  Synthetic primer
gggagatataggtgcccagag

SEQ ID NO: 1433 - DNA, 20 bp, Artificial Sequence
  Synthetic primer
aatccagatgccgtgaattt

SEQ ID NO: 1434 - DNA, 20 bp, Artificial Sequence
  Synthetic primer
accatgcttgaggacaacag

SEQ ID NO: 1435 - DNA, 18 bp, Artificial Sequence
  Synthetic primer
cgatgccctgaggaatca

SEQ ID NO: 1436 - DNA, 20 bp, Artificial Sequence
  Synthetic primer
ccttcaagtggatggtgttg

SEQ ID NO: 1437 - DNA, 18 bp, Artificial Sequence
  Synthetic primer
atgtcttccagttggcgg

SEQ ID NO: 1438 - DNA, 18 bp, Artificial Sequence
  Synthetic primer
gcgaatgccatgactgaa

SEQ ID NO: 1439 - DNA, 19 bp, Artificial Sequence
  Synthetic primer
ctggtagcctgggcataga

SEQ ID NO: 1440 - DNA, 20 bp, Artificial Sequence
  Synthetic primer
atggtccctacccatttgaa

SEQ ID NO: 1441 - DNA, 20 bp, Artificial Sequence
  Synthetic primer
agaggtcaacacagttgcga

SEQ ID NO: 1442 - DNA, 21 bp, Artificial Sequence
  Synthetic primer
aggatctacccctttcagtgg

SEQ ID NO: 1443 - DNA, 18 bp, Artificial Sequence
  Synthetic primer
ttacgcagctgctgttgg

SEQ ID NO: 1444 - DNA, 20 bp, Artificial Sequence
  Synthetic primer
ctgcggatccagggtaagaa

SEQ ID NO: 1445 - DNA, 19 bp, Artificial Sequence
  Synthetic primer
ggaatggccacaactgaga

SEQ ID NO: 1446 - DNA, 24 bp, Artificial Sequence
  Synthetic primer
tgctgtcgtgatgagaaaatagtg

SEQ ID NO: 1447 - DNA, 18 bp, Artificial Sequence
  Synthetic primer
agaaagcgcctgaggtcc

SEQ ID NO: 1448 - DNA, 20 bp, Artificial Sequence
  Synthetic primer
agttacaagccagggaagga

SEQ ID NO: 1449 - DNA, 18 bp, Artificial Sequence
  Synthetic primer
gcagcctgggaccacttg

SEQ ID NO: 1450 - DNA, 22 bp, Artificial Sequence
  Synthetic primer
ggtaccggatcatgaggatctg

SEQ ID NO: 1451 - DNA, 20 bp, Artificial Sequence
  Synthetic primer
aagacttgtccctgcctcac

SEQ ID NO: 1452 - DNA, 22 bp, Artificial Sequence
  Synthetic primer
gcttcaacggcaaagttctctt

SEQ ID NO: 1453 - DNA, 22 bp, Artificial Sequence
  Synthetic primer
gctcaaagctggtattggagac

SEQ ID NO: 1454 - DNA, 19 bp, Artificial Sequence
  Synthetic primer
gtactgagcgatggagcgt

SEQ ID NO: 1455 - DNA, 19 bp, Artificial Sequence
  Synthetic primer
ccagtctcccattcaccgt

SEQ ID NO: 1456 - DNA, 19 bp, Artificial Sequence
  Synthetic primer
cactcgcagatgcgtcttt

SEQ ID NO: 1457 - DNA, 24 bp, Artificial Sequence
  Synthetic primer
caaactccacagtacttgggttga

SEQ ID NO: 1458 - DNA, 20 bp, Artificial Sequence
  Synthetic primer
ttattgcagcctgggtaagc

SEQ ID NO: 1459 - DNA, 21 bp, Artificial Sequence
  Synthetic primer
agctccctgttgcatggactt

SEQ ID NO: 1460 - DNA, 20 bp, Artificial Sequence
  Synthetic primer
gccacaactgtcccagtctt

SEQ ID NO: 1461 - DNA, 21 bp, Artificial Sequence
  Synthetic primer
tgcgtggcactattttcaaga

SEQ ID NO: 1462 - DNA, 20 bp, Artificial Sequence
  Synthetic primer
aaggaggatgaatgcaaagg

SEQ ID NO: 1463 - DNA, 22 bp, Artificial Sequence
  Synthetic primer
ggaacaccaccaggacctgtaa

SEQ ID NO: 1464 - DNA, 19 bp, Artificial Sequence
  Synthetic primer
tctccttgaaccaacgcac

SEQ ID NO: 1465 - DNA, 25 bp, Artificial Sequence
  Synthetic probe
atgcctacagcaccctgatgtcgca

SEQ ID NO: 1466 - DNA, 24 bp, Artificial Sequence
  Synthetic probe
cgcttgttccttctccactgggac

SEQ ID NO: 1467 - DNA, 24 bp, Artificial Sequence
  Synthetic probe
cgcttcaaaggaccagacctcctc

SEQ ID NO: 1468 - DNA, 24 bp, Artificial Sequence
  Synthetic probe
ctcgccaatgatgctgctcaagtt

SEQ ID NO: 1469 - DNA, 24 bp, Artificial Sequence
  Synthetic probe
cctcctgaagcctgccatcattgt

SEQ ID NO: 1470 - DNA, 24 bp, Artificial Sequence
  Synthetic probe
tgccctcagcaatgaagcctacaa

SEQ ID NO: 1471 - DNA, 24 bp, Artificial Sequence
  Synthetic probe
cgacctcagatctccagctttccc

SEQ ID NO: 1472 - DNA, 28 bp, Artificial Sequence
  Synthetic probe
tgctacttgcaaaggcgtgtcctactgc

SEQ ID NO: 1473 - DNA, 24 bp, Artificial Sequence
  Synthetic probe
ttcccagttcctgtctacacccgg

SEQ ID NO: 1474 - DNA, 28 bp, Artificial Sequence
  Synthetic probe
caagccaaaggcattggctacttcttcg

SEQ ID NO: 1475 - DNA, 24 bp, Artificial Sequence
  Synthetic probe
tacctccagcagaagccagacacg

SEQ ID NO: 1476 - DNA, 23 bp, Artificial Sequence
  Synthetic probe
ctgcttgctgcaaccagaaccgt

SEQ ID NO: 1477 - DNA, 29 bp, Artificial Sequence
  Synthetic probe
atttacttggcctctcccatgacgattcc

SEQ ID NO: 1478 - DNA, 24 bp, Artificial Sequence
  Synthetic probe
cacacagggtgccatcaatcacct

SEQ ID NO: 1479 - DNA, 24 bp, Artificial Sequence
  Synthetic probe
ccggctcccgttatagggacattc

SEQ ID NO: 1480 - DNA, 24 bp, Artificial Sequence
  Synthetic probe
catgtttaaggcagccatccctcc

SEQ ID NO: 1481 - DNA, 24 bp, Artificial Sequence
  Synthetic probe
atgaccagtgctctgcccatcatc

SEQ ID NO: 1482 - DNA, 25 bp, Artificial Sequence
  Synthetic probe
tttcctcaatggcaaaggtgacaca

SEQ ID NO: 1483 - DNA, 24 bp, Artificial Sequence
  Synthetic probe
tcttgtatcccaccatcttgggcc

SEQ ID NO: 1484 - DNA, 24 bp, Artificial Sequence
  Synthetic probe
cgagtggaagtgctccccactttc

SEQ ID NO: 1485 - DNA, 24 bp, Artificial Sequence
  Synthetic probe
caacacgtcaccaccctttgctct

SEQ ID NO: 1486 - DNA, 24 bp, Artificial Sequence
  Synthetic probe
tgagaccctccaccttgtccaggt

SEQ ID NO: 1487 - DNA, 24 bp, Artificial Sequence
  Synthetic probe
attgttcacccaatgaagtcccgc

SEQ ID NO: 1488 - DNA, 24 bp, Artificial Sequence
  Synthetic probe
caggctagccaaacggtccaactc

SEQ ID NO: 1489 - DNA, 24 bp, Artificial Sequence
  Synthetic probe
atctcttgcccagcatcatcctga

SEQ ID NO: 1490 - DNA, 24 bp, Artificial Sequence
  Synthetic probe
cagccctggactacctgcactcgg

SEQ ID NO: 1491 - DNA, 24 bp, Artificial Sequence
  Synthetic probe
caggtcacgtccgaggtcgacaca

SEQ ID NO: 1492 - DNA, 23 bp, Artificial Sequence
  Synthetic probe
tcacggtacacaatctttccgga

SEQ ID NO: 1493 - DNA, 22 bp, Artificial Sequence
  Synthetic probe
ctgcagcgtcaatctccgcttg

SEQ ID NO: 1494 - DNA, 24 bp, Artificial Sequence
  Synthetic probe
cagccacttcttggcttctcccac

SEQ ID NO: 1495 - DNA, 24 bp, Artificial Sequence
  Synthetic probe
tgccagagcctcaactgtctctgc

SEQ ID NO: 1496 - DNA, 26 bp, Artificial Sequence
  Synthetic probe
tccccttttccttgaggatgtttctg

SEQ ID NO: 1497 - DNA, 24 bp, Artificial Sequence
  Synthetic probe
catgctgttgagacgctcgacctc

SEQ ID NO: 1498 - DNA, 24 bp, Artificial Sequence
  Synthetic probe
ccgcatgccgtacacgtagacatc

SEQ ID NO: 1499 - DNA, 23 bp, Artificial Sequence
  Synthetic probe
cagtaactcggggcctgtttccc

SEQ ID NO: 1500 - DNA, 28 bp, Artificial Sequence
  Synthetic probe
tcacgtggctcgactatagaaaactcca

SEQ ID NO: 1501 - DNA, 24 bp, Artificial Sequence
  Synthetic probe
aagctgacacagccctcccaagtg

SEQ ID NO: 1502 - DNA, 24 bp, Artificial Sequence
  Synthetic probe
tctccagaagcacctcaggctcct

SEQ ID NO: 1503 - DNA, 24 bp, Artificial Sequence
  Synthetic probe
ccaatgcaatcccggaaaacaaag

SEQ ID NO: 1504 - DNA, 24 bp, Artificial Sequence
  Synthetic probe
catcgtggcgcctctgaattactg

SEQ ID NO: 1505 - DNA, 24 bp, Artificial Sequence
  Synthetic probe
tcacccaggcggtagtacactcca

SEQ ID NO: 1506 - DNA, 24 bp, Artificial Sequence
  Synthetic probe
agccttctcccacagctgcctaca

SEQ ID NO: 1507 - DNA, 19 bp, Artificial Sequence
  Synthetic probe
tcctcggatgtcgctgcct

SEQ ID NO: 1508 - DNA, 24 bp, Artificial Sequence
  Synthetic probe
ccaccacacaggtacagcagcgct

SEQ ID NO: 1509 - DNA, 24 bp, Artificial Sequence
  Synthetic probe
tgtctcacgagagcatcgtccaga

SEQ ID NO: 1510 - DNA, 24 bp, Artificial Sequence
  Synthetic probe
agtaccctgaagtgtcccccacca

SEQ ID NO: 1511 - DNA, 24 bp, Artificial Sequence
  Synthetic probe
ctatgacgatgccctcaacgcctc

SEQ ID NO: 1512 - DNA, 24 bp, Artificial Sequence
  Synthetic probe
cttcatcccgcctgatggtgactt

SEQ ID NO: 1513 - DNA, 25 bp, Artificial Sequence
  Synthetic probe
tgcaattcagcagaagctctccaaa

SEQ ID NO: 1514 - DNA, 22 bp, Artificial Sequence
  Synthetic probe
cattggctccccgtgacctgta

SEQ ID NO: 1515 - DNA, 23 bp, Artificial Sequence
  Synthetic probe
aggacaggacctcccaaccaagc

SEQ ID NO: 1516 - DNA, 22 bp, Artificial Sequence
  Synthetic probe
actggcgctgcatgtcttccac

SEQ ID NO: 1517 - DNA, 24 bp, Artificial Sequence
  Synthetic probe
aggcatatctctcctggtggctgc

SEQ ID NO: 1518 - DNA, 24 bp, Artificial Sequence
  Synthetic probe
cagctctgcaccaagtccagtcgt

SEQ ID NO: 1519 - DNA, 24 bp, Artificial Sequence
  Synthetic probe
acagccttccctctgcattgacct

SEQ ID NO: 1520 - DNA, 23 bp, Artificial Sequence
  Synthetic probe
ccgtcctcgggagccgactatga

SEQ ID NO: 1521 - DNA, 22 bp, Artificial Sequence
  Synthetic probe
cttgtccttgggtcaccctgca

SEQ ID NO: 1522 - DNA, 24 bp, Artificial Sequence
  Synthetic probe
agcttgctcagtccgtgcacaaaa

SEQ ID NO: 1523 - DNA, 24 bp, Artificial Sequence
  Synthetic probe
ctgttcacacgctcagcctgtctg

SEQ ID NO: 1524 - DNA, 24 bp, Artificial Sequence
  Synthetic probe
ccacggtctggtcttcagctaccc

SEQ ID NO: 1525 - DNA, 24 bp, Artificial Sequence
  Synthetic probe
taaaaccgggctttcacccaacct

SEQ ID NO: 1526 - DNA, 24 bp, Artificial Sequence
  Synthetic probe
ctgggcgagcacgcttaccctttc

SEQ ID NO: 1527 - DNA, 22 bp, Artificial Sequence
  Synthetic probe
tctacaaccggttcaagggccg

SEQ ID NO: 1528 - DNA, 24 bp, Artificial Sequence
  Synthetic probe
acctaggactcgttctccgaggcc

SEQ ID NO: 1529 - DNA, 24 bp, Artificial Sequence
  Synthetic probe
tccagcctgtctccagtaggccac

SEQ ID NO: 1530 - DNA, 24 bp, Artificial Sequence
  Synthetic probe
cttcctgaacttggccaatgaccc

SEQ ID NO: 1531 - DNA, 24 bp, Artificial Sequence
  Synthetic probe
tatcccacctccatcccagacagg

SEQ ID NO: 1532 - DNA, 24 bp, Artificial Sequence
  Synthetic probe
ccatcgatccagtctcggaagagc

SEQ ID NO: 1533 - DNA, 29 bp, Artificial Sequence
  Synthetic probe
aggctcagtgatgtcttccctgtcaccag

SEQ ID NO: 1534 - DNA, 24 bp, Artificial Sequence
  Synthetic probe
cggcatcttcaaacctccatgatg

SEQ ID NO: 1535 - DNA, 24 bp, Artificial Sequence
  Synthetic probe
tgggcccagagcatgttccagatc

SEQ ID NO: 1536 - DNA, 26 bp, Artificial Sequence
  Synthetic probe
cccaattaacatgacccggcaaccat

SEQ ID NO: 1537 - DNA, 24 bp, Artificial Sequence
  Synthetic probe
ttccatgccagacaggaaaaagca

SEQ ID NO: 1538 - DNA, 21 bp, Artificial Sequence
  Synthetic probe
acaccccagacgtcctggcct

SEQ ID NO: 1539 - DNA, 25 bp, Artificial Sequence
  Synthetic probe
tgccactcggaaaaagacctctcgg

SEQ ID NO: 1540 - DNA, 24 bp, Artificial Sequence
  Synthetic probe
catcatgggactcctgcccttacc

SEQ ID NO: 1541 - DNA, 22 bp, Artificial Sequence
  Synthetic probe
ttccacgccgaaggacagcgat

SEQ ID NO: 1542 - DNA, 27 bp, Artificial Sequence
  Synthetic probe
cagtcaagctcagtgagcattctcagc

SEQ ID NO: 1543 - DNA, 24 bp, Artificial Sequence
  Synthetic probe
tccgggtagctctcaaactcgagg

SEQ ID NO: 1544 - DNA, 20 bp, Artificial Sequence
  Synthetic probe
ttcggctctcggctgctgca

SEQ ID NO: 1545 - DNA, 24 bp, Artificial Sequence
  Synthetic probe
cagggcatcgatctctcaccctgg

SEQ ID NO: 1546 - DNA, 26 bp, Artificial Sequence
  Synthetic probe
ttcgccaggtcattgagatccatcca

SEQ ID NO: 1547 - DNA, 24 bp, Artificial Sequence
  Synthetic probe
caagggtctccagcacctctacgc

SEQ ID NO: 1548 - DNA, 24 bp, Artificial Sequence
  Synthetic probe
aggaagctccctgaatccttgcgt

SEQ ID NO: 1549 - DNA, 23 bp, Artificial Sequence
  Synthetic probe
ccggttaactgtggcctgtgccc

SEQ ID NO: 1550 - DNA, 21 bp, Artificial Sequence
  Synthetic probe
cttcgcctccagatggctccc

SEQ ID NO: 1551 - DNA, 24 bp, Artificial Sequence
  Synthetic probe
ccaggggcagctacctgaactcaa

SEQ ID NO: 1552 - DNA, 24 bp, Artificial Sequence
  Synthetic probe
ctctcactgtgacagcccacctcg

SEQ ID NO: 1553 - DNA, 23 bp, Artificial Sequence
  Synthetic probe
ctatgggcccttcaccaacatgc

SEQ ID NO: 1554 - DNA, 23 bp, Artificial Sequence
  Synthetic probe
cagtcggcccaggacggtctact

SEQ ID NO: 1555 - DNA, 23 bp, Artificial Sequence
  Synthetic probe
tgctgggagcctacacttggccc

SEQ ID NO: 1556 - DNA, 24 bp, Artificial Sequence
  Synthetic probe
cctcgctttgtttaacagcccagg

SEQ ID NO: 1557 - DNA, 24 bp, Artificial Sequence
  Synthetic probe
ttacagcgacagtcatggccgcat

SEQ ID NO: 1558 - DNA, 24 bp, Artificial Sequence
  Synthetic probe
tgcactcaaccttctaccaggcca

SEQ ID NO: 1559 - DNA, 24 bp, Artificial Sequence
  Synthetic probe
agaaccgtaccagaaccactccgg

SEQ ID NO: 1560 - DNA, 24 bp, Artificial Sequence
  Synthetic probe
tcccaggaggcgtctgacacagta

SEQ ID NO: 1561 - DNA, 19 bp, Artificial Sequence
  Synthetic probe
caggtcccattgccgggcg

SEQ ID NO: 1562 - DNA, 24 bp, Artificial Sequence
  Synthetic probe
acatcccacctgcagacctcagtg

SEQ ID NO: 1563 - DNA, 24 bp, Artificial Sequence
  Synthetic probe
caacccccagagattccgattcag

SEQ ID NO: 1564 - DNA, 24 bp, Artificial Sequence
  Synthetic probe
atgctctgccctctgcatctcaga

SEQ ID NO: 1565 - DNA, 24 bp, Artificial Sequence
  Synthetic probe
agacaccagtgcttctccagggct

SEQ ID NO: 1566 - DNA, 24 bp, Artificial Sequence
  Synthetic probe
cctcccttgagcactgctttgtcc

SEQ ID NO: 1567 - DNA, 20 bp, Artificial Sequence
  Synthetic probe
tttgctgtcaccagcgtcgc

SEQ ID NO: 1568 - DNA, 24 bp, Artificial Sequence
  Synthetic probe
ccatggcataacactaaggcgcag

SEQ ID NO: 1569 - DNA, 26 bp, Artificial Sequence
  Synthetic probe
aacccaagctcaagacgcaggacgag

SEQ ID NO: 1570 - DNA, 24 bp, Artificial Sequence
  Synthetic probe
cgctttctgctcttccacaccaga

SEQ ID NO: 1571 - DNA, 24 bp, Artificial Sequence
  Synthetic probe
tctactgcatctgccagccctgag

SEQ ID NO: 1572 - DNA, 24 bp, Artificial Sequence
  Synthetic probe
aaagtccactcggcgctgagaaac

SEQ ID NO: 1573 - DNA, 25 bp, Artificial Sequence
  Synthetic probe
tcagcctgttccatgaaggcagagc

SEQ ID NO: 1574 - DNA, 28 bp, Artificial Sequence
  Synthetic probe
tggcctcacaaggactaccctctcatcc

SEQ ID NO: 1575 - DNA, 24 bp, Artificial Sequence
  Synthetic probe
atttcagctgatcagtgggcctcc

SEQ ID NO: 1576 - DNA, 24 bp, Artificial Sequence
  Synthetic probe
cccgtactgtcatgcctcagagct

SEQ ID NO: 1577 - DNA, 24 bp, Artificial Sequence
  Synthetic probe
caacaaagagctctgctgcctcgt

SEQ ID NO: 1578 - DNA, 24 bp, Artificial Sequence
  Synthetic probe
cgcttcatcttggctgaggtcctc

SEQ ID NO: 1579 - DNA, 26 bp, Artificial Sequence
  Synthetic probe
cagcactgacatcaaagcagccagga

SEQ ID NO: 1580 - DNA, 18 bp, Artificial Sequence
  Synthetic probe
actgaactgagctgctca

SEQ ID NO: 1581 - DNA, 22 bp, Artificial Sequence
  Synthetic probe
acagagccctggcaaagccaag

SEQ ID NO: 1582 - DNA, 27 bp, Artificial Sequence
  Synthetic probe
tgtctccattattgatcggttcatgca

SEQ ID NO: 1583 - DNA, 23 bp, Artificial Sequence
  Synthetic probe
aaggagaccatccccctgacggc

SEQ ID NO: 1584 - DNA, 24 bp, Artificial Sequence
  Synthetic probe
caaactcaacgtgcaagcctcgga

SEQ ID NO: 1585 - DNA, 30 bp, Artificial Sequence
  Synthetic probe
cccagataatacaggtggccaacaattcct

SEQ ID NO: 1586 - DNA, 30 bp, Artificial Sequence
  Synthetic probe
taccaagcaacctacatgtcaagaaagccc

SEQ ID NO: 1587 - DNA, 24 bp, Artificial Sequence
  Synthetic probe
actcaccacacctgcagccttcac

SEQ ID NO: 1588 - DNA, 24 bp, Artificial Sequence
  Synthetic probe
tcttctcgtttcgacaccgaagca

SEQ ID NO: 1589 - DNA, 26 bp, Artificial Sequence
  Synthetic probe
tccttcaggactgcacctttgaaaga

SEQ ID NO: 1590 - DNA, 25 bp, Artificial Sequence
  Synthetic probe
tggaataagtacctaaggcgccccc

SEQ ID NO: 1591 - DNA, 21 bp, Artificial Sequence
  Synthetic probe
ctcccatcccagtggagccaa

SEQ ID NO: 1592 - DNA, 27 bp, Artificial Sequence
  Synthetic probe
cgacaggatattgaccaccgcctcatt

SEQ ID NO: 1593 - DNA, 24 bp, Artificial Sequence
  Synthetic probe
caaggaactgacgctcgaggacct

SEQ ID NO: 1594 - DNA, 20 bp, Artificial Sequence
  Synthetic probe
cgcggccgagacatggcttg

SEQ ID NO: 1595 - DNA, 22 bp, Artificial Sequence
  Synthetic probe
cgcaccattcggtcatttgagg

SEQ ID NO: 1596 - DNA, 23 bp, Artificial Sequence
  Synthetic probe
ctgttgactgcagggcaccacca

SEQ ID NO: 1597 - DNA, 27 bp, Artificial Sequence
  Synthetic probe
cacagtaattcgcttgtagtcggcacc

SEQ ID NO: 1598 - DNA, 25 bp, Artificial Sequence
  Synthetic probe
tttatgaacctgccctgctcccaca

SEQ ID NO: 1599 - DNA, 24 bp, Artificial Sequence
  Synthetic probe
ctgttcttggggccctacaccttg

SEQ ID NO: 1600 - DNA, 24 bp, Artificial Sequence
  Synthetic probe
cacagtctctttcctgcagcccaa

SEQ ID NO: 1601 - DNA, 18 bp, Artificial Sequence
  Synthetic probe
caccgcggccatcctgca

SEQ ID NO: 1602 - DNA, 24 bp, Artificial Sequence
  Synthetic probe
caggtcccttgtcccaagttccac

SEQ ID NO: 1603 - DNA, 24 bp, Artificial Sequence
  Synthetic probe
actggaacccagaagcacaccctc

SEQ ID NO: 1604 - DNA, 24 bp, Artificial Sequence
  Synthetic probe
caccgacagcacagacagaatccc

SEQ ID NO: 1605 - DNA, 24 bp, Artificial Sequence
  Synthetic probe
caccaagcccagaggacagttcct

SEQ ID NO: 1606 - DNA, 24 bp, Artificial Sequence
  Synthetic probe
cacgctgccttggtgctattgtct

SEQ ID NO: 1607 - DNA, 28 bp, Artificial Sequence
  Synthetic probe
ctccaagcccagattcagattcgagtca

SEQ ID NO: 1608 - DNA, 30 bp, Artificial Sequence
  Synthetic probe
tcagcttctacaactggacagacaacgctg

SEQ ID NO: 1609 - DNA, 26 bp, Artificial Sequence
  Synthetic probe
ccaacggcaagggaacaagtacttct

SEQ ID NO: 1610 - DNA, 20 bp, Artificial Sequence
  Synthetic probe
tccacctgaaacgccatccg

SEQ ID NO: 1611 - DNA, 28 bp, Artificial Sequence
  Synthetic probe
tgtccctgttagacgtcctccgtccata

SEQ ID NO: 1612 - DNA, 24 bp, Artificial Sequence
  Synthetic probe
cctcaccggcatagactggaagcg

SEQ ID NO: 1613 - DNA, 27 bp, Artificial Sequence
  Synthetic probe
tgccaatcccgatgaaattggaaattt

SEQ ID NO: 1614 - DNA, 24 bp, Artificial Sequence
  Synthetic probe
agtctgaatgctgccacaaccagc

SEQ ID NO: 1615 - DNA, 24 bp, Artificial Sequence
  Synthetic probe
cagaggccaagctcccagctagag

SEQ ID NO: 1616 - DNA, 24 bp, Artificial Sequence
  Synthetic probe
atacaccagcctggaacgcagtgt

SEQ ID NO: 1617 - DNA, 24 bp, Artificial Sequence
  Synthetic probe
tattctcccggtccagcctctcaa

SEQ ID NO: 1618 - DNA, 24 bp, Artificial Sequence
  Synthetic probe
tttcttccctgtccagcctcttgg

SEQ ID NO: 1619 - DNA, 24 bp, Artificial Sequence
  Synthetic probe
ccagtcgcctcagtaaagccacct

SEQ ID NO: 1620 - DNA, 24 bp, Artificial Sequence
  Synthetic probe
tctttgcacctttccaggtcctgg

SEQ ID NO: 1621 - DNA, 24 bp, Artificial Sequence
  Synthetic probe
cgcaagaaatgcccacatgaatgt

SEQ ID NO: 1622 - DNA, 23 bp, Artificial Sequence
  Synthetic probe
tccttcccacccccagtcctgtc

SEQ ID NO: 1623 - DNA, 24 bp, Artificial Sequence
  Synthetic probe
aaaatgagactctccgtcggcagc

SEQ ID NO: 1624 - DNA, 24 bp, Artificial Sequence
  Synthetic probe
acactggaccaggagtgcatccag

SEQ ID NO: 1625 - DNA, 24 bp, Artificial Sequence
  Synthetic probe
ctcctcccgtggtccttgttgtct

SEQ ID NO: 1626 - DNA, 22 bp, Artificial Sequence
  Synthetic probe
tgctgatgtgccctctccttgg

SEQ ID NO: 1627 - DNA, 26 bp, Artificial Sequence
  Synthetic probe
ccagcccacatgtcctgatcatatgc

SEQ ID NO: 1628 - DNA, 29 bp, Artificial Sequence
  Synthetic probe
agtcccaacagaaacaagaacttcaggcg

SEQ ID NO: 1629 - DNA, 30 bp, Artificial Sequence
  Synthetic probe
tgacatagcatcatcctttggttcccagtt

SEQ ID NO: 1630 - DNA, 30 bp, Artificial Sequence
  Synthetic probe
tctccatcaaatcctgtaaactccagagca

SEQ ID NO: 1631 - DNA, 24 bp, Artificial Sequence
  Synthetic probe
agagacttccctgcatgaggcaca

SEQ ID NO: 1632 - DNA, 24 bp, Artificial Sequence
  Synthetic probe
tggaaagaacccaacgcgttacct

SEQ ID NO: 1633 - DNA, 24 bp, Artificial Sequence
  Synthetic probe
tgcactgctctcctgttcctgtcc

SEQ ID NO: 1634 - DNA, 20 bp, Artificial Sequence
  Synthetic probe
cccttcagcctgccccaccg

SEQ ID NO: 1635 - DNA, 23 bp, Artificial Sequence
  Synthetic probe
tgcctctctgccccaccctttgt

SEQ ID NO: 1636 - DNA, 27 bp, Artificial Sequence
  Synthetic probe
tctgacactgtccaacttgaccctctt

SEQ ID NO: 1637 - DNA, 25 bp, Artificial Sequence
  Synthetic probe
cgtgctctgcattgagaacagcttc

SEQ ID NO: 1638 - DNA, 21 bp, Artificial Sequence
  Synthetic probe
tcctgcgcctgatgtccaccg

SEQ ID NO: 1639 - DNA, 30 bp, Artificial Sequence
  Synthetic probe
tctcctagccagacgtgtttcttgtccttg

SEQ ID NO: 1640 - DNA, 24 bp, Artificial Sequence
  Synthetic probe
ctcctttgacaccagggatgccat

SEQ ID NO: 1641 - DNA, 24 bp, Artificial Sequence
  Synthetic probe
actatgccagccggaacgacaagt

SEQ ID NO: 1642 - DNA, 24 bp, Artificial Sequence
  Synthetic probe
ccaggaaatcctgtagcaccaggc

SEQ ID NO: 1643 - DNA, 24 bp, Artificial Sequence
  Synthetic probe
cttgtcaccagggtccccattgtc

SEQ ID NO: 1644 - DNA, 28 bp, Artificial Sequence
  Synthetic probe
caggatacagctccacagcatcgatgtc

SEQ ID NO: 1645 - DNA, 24 bp, Artificial Sequence
  Synthetic probe
tcttcagggcctctctcctttcga

SEQ ID NO: 1646 - DNA, 24 bp, Artificial Sequence
  Synthetic probe
cggagcgttacatcaaacccacct

SEQ ID NO: 1647 - DNA, 24 bp, Artificial Sequence
  Synthetic probe
catgactcagggacacactcccca

SEQ ID NO: 1648 - DNA, 25 bp, Artificial Sequence
  Synthetic probe
cctggctgcccaagaagtgttccct

SEQ ID NO: 1649 - DNA, 24 bp, Artificial Sequence
  Synthetic probe
ctgtcagaggagcccatctcccat

SEQ ID NO: 1650 - DNA, 28 bp, Artificial Sequence
  Synthetic probe
tcagatggagacctcgtgccaaattaca

SEQ ID NO: 1651 - DNA, 21 bp, Artificial Sequence
  Synthetic probe
agccactccccacgctgttgt

SEQ ID NO: 1652 - DNA, 25 bp, Artificial Sequence
  Synthetic probe
atcccctttgactgctgggagccag

SEQ ID NO: 1653 - DNA, 24 bp, Artificial Sequence
  Synthetic probe
cgcagatccgatttctctgggatc

SEQ ID NO: 1654 - DNA, 29 bp, Artificial Sequence
  Synthetic probe
tgcatttctgagtttcattctcctgcctg

SEQ ID NO: 1655 - DNA, 28 bp, Artificial Sequence
  Synthetic probe
aacatcatgttcttcttcatgacctcgc

SEQ ID NO: 1656 - DNA, 21 bp, Artificial Sequence
  Synthetic probe
ccccgtggagggagctttctc

SEQ ID NO: 1657 - DNA, 22 bp, Artificial Sequence
  Synthetic probe
accctgcccgcgatcacactga

SEQ ID NO: 1658 - DNA, 24 bp, Artificial Sequence
  Synthetic probe
tggctacatccttgacaaagccga

SEQ ID NO: 1659 - DNA, 29 bp, Artificial Sequence
  Synthetic probe
ttgaggcccagagcagtctaccagattct

SEQ ID NO: 1660 - DNA, 24 bp, Artificial Sequence
  Synthetic probe
cttgaggacgcgaacagtccacca

SEQ ID NO: 1661 - DNA, 28 bp, Artificial Sequence
  Synthetic probe
tgataacaagggcatcgactcagacgct

SEQ ID NO: 1662 - DNA, 24 bp, Artificial Sequence
  Synthetic probe
tgccccatcctatcacatccttca

SEQ ID NO: 1663 - DNA, 24 bp, Artificial Sequence
  Synthetic probe
cagccacaaagccagcgtcattgt

SEQ ID NO: 1664 - DNA, 24 bp, Artificial Sequence
  Synthetic probe
tatgtgctgcagaactccacgctg

SEQ ID NO: 1665 - DNA, 24 bp, Artificial Sequence
  Synthetic probe
tagaacccagcccataagaggccc

SEQ ID NO: 1666 - DNA, 23 bp, Artificial Sequence
  Synthetic probe
actgagggccagcctcagatcct

SEQ ID NO: 1667 - DNA, 24 bp, Artificial Sequence
  Synthetic probe
tctgtgtggtccatccttggaagc

SEQ ID NO: 1668 - DNA, 24 bp, Artificial Sequence
  Synthetic probe
ttcttcgaaagccatgttgccaga

SEQ ID NO: 1669 - DNA, 24 bp, Artificial Sequence
  Synthetic probe
tacccttaagaacgccccctccac

SEQ ID NO: 1670 - DNA, 24 bp, Artificial Sequence
  Synthetic probe
tgctggctctttcctggctactcc

SEQ ID NO: 1671 - DNA, 28 bp, Artificial Sequence
  Synthetic probe
ctgaaactggaacacaaccacccacaag

SEQ ID NO: 1672 - DNA, 24 bp, Artificial Sequence
  Synthetic probe
ctggtgaacctacccctggctgac

SEQ ID NO: 1673 - DNA, 24 bp, Artificial Sequence
  Synthetic probe
ttttctcaactcctccacaaggca

SEQ ID NO: 1674 - DNA, 24 bp, Artificial Sequence
  Synthetic probe
atacagtgaccttgtccccaccgg

SEQ ID NO: 1675 - DNA, 26 bp, Artificial Sequence
  Synthetic probe
cacaccctttggaagtggacccagaa

SEQ ID NO: 1676 - DNA, 24 bp, Artificial Sequence
  Synthetic probe
cagcacccttggcagtttcgaaat

SEQ ID NO: 1677 - DNA, 24 bp, Artificial Sequence
  Synthetic probe
caagtcagagtttccctggtgccc

SEQ ID NO: 1678 - DNA, 25 bp, Artificial Sequence
  Synthetic probe
tcatatccaaactcgcctccagccg

SEQ ID NO: 1679 - DNA, 24 bp, Artificial Sequence
  Synthetic probe
catgcctatgctgaaccactccca

SEQ ID NO: 1680 - DNA, 24 bp, Artificial Sequence
  Synthetic probe
atcactggaactcctcggtcggac

SEQ ID NO: 1681 - DNA, 24 bp, Artificial Sequence
  Synthetic probe
ctgcttgcacaagtttcctgggct

SEQ ID NO: 1682 - DNA, 20 bp, Artificial Sequence
  Synthetic probe
tcagcatgtccagggcaccc

SEQ ID NO: 1683 - DNA, 24 bp, Artificial Sequence
  Synthetic probe
cctctccttcggaattcacttgcg

SEQ ID NO: 1684 - DNA, 24 bp, Artificial Sequence
  Synthetic probe
ctcacaggccttggccacagatct

SEQ ID NO: 1685 - DNA, 21 bp, Artificial Sequence
  Synthetic probe
ctatgcccgggactcgggcct

SEQ ID NO: 1686 - DNA, 24 bp, Artificial Sequence
  Synthetic probe
ctcattgggcaccagcaggtttcc

SEQ ID NO: 1687 - DNA, 23 bp, Artificial Sequence
  Synthetic probe
aagttacgctgcgcgacagccaa

SEQ ID NO: 1688 - DNA, 22 bp, Artificial Sequence
  Synthetic probe
ttcttctgtctcccgccgcttc

SEQ ID NO: 1689 - DNA, 25 bp, Artificial Sequence
  Synthetic probe
agaaaagctgtttgtctccccagca

SEQ ID NO: 1690 - DNA, 24 bp, Artificial Sequence
  Synthetic probe
tgctgagcctcccacactcatctc

SEQ ID NO: 1691 - DNA, 24 bp, Artificial Sequence
  Synthetic probe
aaagtccatttgccactgatggca

SEQ ID NO: 1692 - DNA, 24 bp, Artificial Sequence
  Synthetic probe
ctacctggacatccctgctcagcc

SEQ ID NO: 1693 - DNA, 24 bp, Artificial Sequence
  Synthetic probe
cacatgcaaggaccagcatctcct

SEQ ID NO: 1694 - DNA, 24 bp, Artificial Sequence
  Synthetic probe
caccatgtcatgggtccacctttg

SEQ ID NO: 1695 - DNA, 29 bp, Artificial Sequence
  Synthetic probe
caatgcttccaacaatttgtttgcttgcc

SEQ ID NO: 1696 - DNA, 23 bp, Artificial Sequence
  Synthetic probe
cagacttggtgccctttgactcc

SEQ ID NO: 1697 - DNA, 26 bp, Artificial Sequence
  Synthetic probe
cgaggccattgacttcatagactcca

SEQ ID NO: 1698 - DNA, 20 bp, Artificial Sequence
  Synthetic probe
cgctcggagcctgcctcttc

SEQ ID NO: 1699 - DNA, 24 bp, Artificial Sequence
  Synthetic probe
cagaagaacagctcagggacccct

SEQ ID NO: 1700 - DNA, 24 bp, Artificial Sequence
  Synthetic probe
cagtgggttttgattcccaccatg

SEQ ID NO: 1701 - DNA, 24 bp, Artificial Sequence
  Synthetic probe
atttccacttatgccacctgggcc

SEQ ID NO: 1702 - DNA, 24 bp, Artificial Sequence
  Synthetic probe
cgaagtggaaagcatcttgccaca

SEQ ID NO: 1703 - DNA, 23 bp, Artificial Sequence
  Synthetic probe
cactcccgagcacgttgttccgt

SEQ ID NO: 1704 - DNA, 29 bp, Artificial Sequence
  Synthetic probe
ccacttggacatcatctgggtgaacactc

SEQ ID NO: 1705 - DNA, 23 bp, Artificial Sequence
  Synthetic probe
cctttgcctcagggcatcctttt

SEQ ID NO: 1706 - DNA, 24 bp, Artificial Sequence
  Synthetic probe
tgctacctgcccctttgtcatgtg

SEQ ID NO: 1707 - DNA, 24 bp, Artificial Sequence
  Synthetic probe
caaaggtgaccaccataccgggtt

SEQ ID NO: 1708 - DNA, 24 bp, Artificial Sequence
  Synthetic probe
ccctcaaccccaagttcctgagtg

SEQ ID NO: 1709 - DNA, 24 bp, Artificial Sequence
  Synthetic probe
cggacagcgtcttctgccctcact

SEQ ID NO: 1710 - DNA, 30 bp, Artificial Sequence
  Synthetic probe
agagtttaacagccctgctctggctgactt

SEQ ID NO: 1711 - DNA, 18 bp, Artificial Sequence
  Synthetic probe
cacctgggcagctgccaa

SEQ ID NO: 1712 - DNA, 24 bp, Artificial Sequence
  Synthetic probe
ccggctgggcaaatactacgtcaa

SEQ ID NO: 1713 - DNA, 23 bp, Artificial Sequence
  Synthetic probe
cggatcctttcctcactcgccca

SEQ ID NO: 1714 - DNA, 24 bp, Artificial Sequence
  Synthetic probe
cgttcgcttcaccaaggagatcaa

SEQ ID NO: 1715 - DNA, 26 bp, Artificial Sequence
  Synthetic probe
tgagatggacatttaaagcaccagcc

SEQ ID NO: 1716 - DNA, 24 bp, Artificial Sequence
  Synthetic probe
ctcgctcttctgttccttctcggc

SEQ ID NO: 1717 - DNA, 24 bp, Artificial Sequence
  Synthetic probe
aatgcaagcacttcagcaaccagc

SEQ ID NO: 1718 - DNA, 22 bp, Artificial Sequence
  Synthetic probe
ccagagagcctccctgcagcca

SEQ ID NO: 1719 - DNA, 24 bp, Artificial Sequence
  Synthetic probe
ctgtctctgctcgccctcctttct

SEQ ID NO: 1720 - DNA, 24 bp, Artificial Sequence
  Synthetic probe
tcaagagcatagtggccaccgatc

SEQ ID NO: 1721 - DNA, 24 bp, Artificial Sequence
  Synthetic probe
taacttcctctggcatggttggcc

SEQ ID NO: 1722 - DNA, 23 bp, Artificial Sequence
  Synthetic probe
tgtcgccatcttgggtcaccacg

SEQ ID NO: 1723 - DNA, 24 bp, Artificial Sequence
  Synthetic probe
ctctccttccctctggctctgtgc

SEQ ID NO: 1724 - DNA, 20 bp, Artificial Sequence
  Synthetic probe
tgcgcccgatgagatcaccg

SEQ ID NO: 1725 - DNA, 24 bp, Artificial Sequence
  Synthetic probe
atggcctctggagctgtccatctc

SEQ ID NO: 1726 - DNA, 24 bp, Artificial Sequence
  Synthetic probe
cacctgatgcatgatggacactgc

SEQ ID NO: 1727 - DNA, 24 bp, Artificial Sequence
  Synthetic probe
cgtcccatttgagcctgtcaatgt

SEQ ID NO: 1728 - DNA, 24 bp, Artificial Sequence
  Synthetic probe
ctctctggacagttcctctggccc

SEQ ID NO: 1729 - DNA, 25 bp, Artificial Sequence
  Synthetic probe
cctcaaaggtactccctcctcccgg

SEQ ID NO: 1730 - DNA, 30 bp, Artificial Sequence
  Synthetic probe
tgtcccacgaataatgcgtaaattctccag

SEQ ID NO: 1731 - DNA, 21 bp, Artificial Sequence
  Synthetic probe
cagcaggccctcaaggagctg

SEQ ID NO: 1732 - DNA, 24 bp, Artificial Sequence
  Synthetic probe
ctggtgctggaactgctcgacact

SEQ ID NO: 1733 - DNA, 30 bp, Artificial Sequence
  Synthetic probe
ttgtttgcatggacagtgcatctatctggt

SEQ ID NO: 1734 - DNA, 24 bp, Artificial Sequence
  Synthetic probe
agccatatgccttctcatctgggc

SEQ ID NO: 1735 - DNA, 20 bp, Artificial Sequence
  Synthetic probe
cgctggctcacccctacctg

SEQ ID NO: 1736 - DNA, 20 bp, Artificial Sequence
  Synthetic probe
tctccagcccgtcttggctt

SEQ ID NO: 1737 - DNA, 23 bp, Artificial Sequence
  Synthetic probe
ctggccctcatgtccccttcacg

SEQ ID NO: 1738 - DNA, 26 bp, Artificial Sequence
  Synthetic probe
ccccagaccaagtgtgaatacatgct

SEQ ID NO: 1739 - DNA, 28 bp, Artificial Sequence
  Synthetic probe
cctcggtagttcgtacccagaccctcag

SEQ ID NO: 1740 - DNA, 21 bp, Artificial Sequence
  Synthetic probe
tggcacgggtcttctcctacc

SEQ ID NO: 1741 - DNA, 24 bp, Artificial Sequence
  Synthetic probe
acattcctcccccaccgtgaattc

SEQ ID NO: 1742 - DNA, 26 bp, Artificial Sequence
  Synthetic probe
tctcagcacattcaagaacacggaga

SEQ ID NO: 1743 - DNA, 24 bp, Artificial Sequence
  Synthetic probe
cggcctgtccacgaaccacttata

SEQ ID NO: 1744 - DNA, 30 bp, Artificial Sequence
  Synthetic probe
tctggaccctcctacctctggttcttacgt

SEQ ID NO: 1745 - DNA, 29 bp, Artificial Sequence
  Synthetic probe
acaacattctcggtgcctgtaacaaagaa

SEQ ID NO: 1746 - DNA, 27 bp, Artificial Sequence
  Synthetic probe
tcattgctccctaaagagttggcactc

SEQ ID NO: 1747 - DNA, 29 bp, Artificial Sequence
  Synthetic probe
ttgtcctcaccctcctctactgtcgactg

SEQ ID NO: 1748 - DNA, 24 bp, Artificial Sequence
  Synthetic probe
cccatgatcttcaagcagggaagc

SEQ ID NO: 1749 - DNA, 24 bp, Artificial Sequence
  Synthetic probe
cagtgtgaccggcaaaattggcac

SEQ ID NO: 1750 - DNA, 25 bp, Artificial Sequence
  Synthetic probe
cgctgagagactctgttctccctgg

SEQ ID NO: 1751 - DNA, 24 bp, Artificial Sequence
  Synthetic probe
acggctcacagacaccaaatgagg

SEQ ID NO: 1752 - DNA, 24 bp, Artificial Sequence
  Synthetic probe
cctgcagactgctttttgcccaat

SEQ ID NO: 1753 - DNA, 24 bp, Artificial Sequence
  Synthetic probe
aggccaccagccagaatcctgata

SEQ ID NO: 1754 - DNA, 27 bp, Artificial Sequence
  Synthetic probe
ataaaaagacaaccaacggccgactgc

SEQ ID NO: 1755 - DNA, 27 bp, Artificial Sequence
  Synthetic probe
tcccagagaccaacgttcaagcagttg

SEQ ID NO: 1756 - DNA, 24 bp, Artificial Sequence
  Synthetic probe
acagtgacagcaacatggttcccc

SEQ ID NO: 1757 - DNA, 23 bp, Artificial Sequence
  Synthetic probe
tcggccacttcatcaggacgcag

SEQ ID NO: 1758 - DNA, 24 bp, Artificial Sequence
  Synthetic probe
tcctatctgccacacatccagcgt

SEQ ID NO: 1759 - DNA, 24 bp, Artificial Sequence
  Synthetic probe
attggtggccacaccacctcctta

SEQ ID NO: 1760 - DNA, 24 bp, Artificial Sequence
  Synthetic probe
cctgacactgactgggttcctcga

SEQ ID NO: 1761 - DNA, 24 bp, Artificial Sequence
  Synthetic probe
tcactcagctttgcttccgacacc

SEQ ID NO: 1762 - DNA, 25 bp, Artificial Sequence
  Synthetic probe
cacactcaccctaacctactggcgg

SEQ ID NO: 1763 - DNA, 24 bp, Artificial Sequence
  Synthetic probe
ctacagcaccaagagcgacgtgtg

SEQ ID NO: 1764 - DNA, 24 bp, Artificial Sequence
  Synthetic probe
agtgtatctccgtgttcacgcgct

SEQ ID NO: 1765 - DNA, 23 bp, Artificial Sequence
  Synthetic probe
agcccgctgaccatggaagatct

SEQ ID NO: 1766 - DNA, 24 bp, Artificial Sequence
  Synthetic probe
actctcaggcggtgtccacatgat

SEQ ID NO: 1767 - DNA, 23 bp, Artificial Sequence
  Synthetic probe
aagccaggccccgaggacaagtt

SEQ ID NO: 1768 - DNA, 22 bp, Artificial Sequence
  Synthetic probe
tcccagcatcatccaggcccag

SEQ ID NO: 1769 - DNA, 24 bp, Artificial Sequence
  Synthetic probe
cctgacggagtccctggatttcac

SEQ ID NO: 1770 - DNA, 26 bp, Artificial Sequence
  Synthetic probe
tccccagggtagaattcaatcagagc

SEQ ID NO: 1771 - DNA, 26 bp, Artificial Sequence
  Synthetic probe
ccagtgacaatgccacttatgccagc

SEQ ID NO: 1772 - DNA, 24 bp, Artificial Sequence
  Synthetic probe
tgcgcttccaccttcttcactgtc

SEQ ID NO: 1773 - DNA, 19 bp, Artificial Sequence
  Synthetic probe
cgcccgcaggcctcatcct

SEQ ID NO: 1774 - DNA, 24 bp, Artificial Sequence
  Synthetic probe
aacttcagccccagctcccaagtc

SEQ ID NO: 1775 - DNA, 24 bp, Artificial Sequence
  Synthetic probe
cctgcaaaagtttcccagcctcct

SEQ ID NO: 1776 - DNA, 24 bp, Artificial Sequence
  Synthetic probe
tgttccaaccactgaatctggacc

SEQ ID NO: 1777 - DNA, 24 bp, Artificial Sequence
  Synthetic probe
aaagttcgctgcacccatcctgtc

SEQ ID NO: 1778 - DNA, 24 bp, Artificial Sequence
  Synthetic probe
cccccgtcagattccagacatagc

SEQ ID NO: 1779 - DNA, 30 bp, Artificial Sequence
  Synthetic probe
ccatggaccaacttcactatgtgacagagc

SEQ ID NO: 1780 - DNA, 21 bp, Artificial Sequence
  Synthetic probe
catctcctggcccagcatgtt

SEQ ID NO: 1781 - DNA, 26 bp, Artificial Sequence
  Synthetic probe
tgcagttgacatggcctgttcagtcc

SEQ ID NO: 1782 - DNA, 24 bp, Artificial Sequence
  Synthetic probe
tttcattctcagaccctgctggcc

SEQ ID NO: 1783 - DNA, 24 bp, Artificial Sequence
  Synthetic probe
atcccctccctctccacccatcta

SEQ ID NO: 1784 - DNA, 24 bp, Artificial Sequence
  Synthetic probe
aggatttctccagcatctgcagca

SEQ ID NO: 1785 - DNA, 24 bp, Artificial Sequence
  Synthetic probe
cctcttgcccacttactgggtgga

SEQ ID NO: 1786 - DNA, 24 bp, Artificial Sequence
  Synthetic probe
cctcccgaattctatgagcatgcc

SEQ ID NO: 1787 - DNA, 24 bp, Artificial Sequence
  Synthetic probe
agcaggcaactccgaaggacaacg

SEQ ID NO: 1788 - DNA, 24 bp, Artificial Sequence
  Synthetic probe
ctcatcacctggtctccggtgtgt

SEQ ID NO: 1789 - DNA, 26 bp, Artificial Sequence
  Synthetic probe
catgctgcatcctaaggctcctcagg

SEQ ID NO: 1790 - DNA, 24 bp, Artificial Sequence
  Synthetic probe
actgatacctcaaccttggggcca

SEQ ID NO: 1791 - DNA, 26 bp, Artificial Sequence
  Synthetic probe
cctccaagcgagtccttcttcaaccg

SEQ ID NO: 1792 - DNA, 23 bp, Artificial Sequence
  Synthetic probe
ctccccacccttgagaagtgcct

SEQ ID NO: 1793 - DNA, 28 bp, Artificial Sequence
  Synthetic probe
cttcctcctcccttctggtcagttggat

SEQ ID NO: 1794 - DNA, 30 bp, Artificial Sequence
  Synthetic probe
tcagccactggcttctgtcataatcaggag

SEQ ID NO: 1795 - DNA, 27 bp, Artificial Sequence
  Synthetic probe
ctcgcaagcacaacatgtgtggtgaga

SEQ ID NO: 1796 - DNA, 26 bp, Artificial Sequence
  Synthetic probe
tcccacaatgaaggtcttgcctccct

SEQ ID NO: 1797 - DNA, 23 bp, Artificial Sequence
  Synthetic probe
cacagccgcctgaaagccacaat

SEQ ID NO: 1798 - DNA, 24 bp, Artificial Sequence
  Synthetic probe
agccacacgcgaaggtgaccttaa

SEQ ID NO: 1799 - DNA, 24 bp, Artificial Sequence
  Synthetic probe
ctggcctccatttcttcaacccag

SEQ ID NO: 1800 - DNA, 24 bp, Artificial Sequence
  Synthetic probe
tcacaactgttccaaccgtcacga

SEQ ID NO: 1801 - DNA, 23 bp, Artificial Sequence
  Synthetic probe
ttcttgcgctccatccgtccaga

SEQ ID NO: 1802 - DNA, 21 bp, Artificial Sequence
  Synthetic probe
ccagaggccgtttcttggccg

SEQ ID NO: 1803 - DNA, 24 bp, Artificial Sequence
  Synthetic probe
ccagaccatagcacactcgggcac

SEQ ID NO: 1804 - DNA, 24 bp, Artificial Sequence
  Synthetic probe
ctgagcagctctcaggatcggctt

SEQ ID NO: 1805 - DNA, 23 bp, Artificial Sequence
  Synthetic probe
ctcatggaccctggtgctacacg

SEQ ID NO: 1806 - DNA, 23 bp, Artificial Sequence
  Synthetic probe
cgctcacgttctcatccaagtgg

SEQ ID NO: 1807 - DNA, 24 bp, Artificial Sequence
  Synthetic probe
ttgcactgcacaggccacattcac

SEQ ID NO: 1808 - DNA, 24 bp, Artificial Sequence
  Synthetic probe
ctctagccagttagcctcgggcag

SEQ ID NO: 1809 - DNA, 24 bp, Artificial Sequence
  Synthetic probe
aactgctgggaaacgcaaagcatc

SEQ ID NO: 1810 - DNA, 22 bp, Artificial Sequence
  Synthetic probe
tcttcacgcctcccctttgtga

SEQ ID NO: 1811 - DNA, 25 bp, Artificial Sequence
  Synthetic probe
tgatcttgagagccctctccttggc

SEQ ID NO: 1812 - DNA, 21 bp, Artificial Sequence
  Synthetic probe
ccccggacagtggctctgacg

SEQ ID NO: 1813 - DNA, 24 bp, Artificial Sequence
  Synthetic probe
tatccaggccagatcaaagtccgg

SEQ ID NO: 1814 - DNA, 24 bp, Artificial Sequence
  Synthetic probe
tgtgactgactgcccattgctcag

SEQ ID NO: 1815 - DNA, 28 bp, Artificial Sequence
  Synthetic probe
ttccacatctctcccagtttcttcgcaa

SEQ ID NO: 1816 - DNA, 28 bp, Artificial Sequence
  Synthetic probe
ctccatatccaaacaaagcatgtgtgcg

SEQ ID NO: 1817 - DNA, 24 bp, Artificial Sequence
  Synthetic probe
tcttccaaggacagtttgccgtca

SEQ ID NO: 1818 - DNA, 24 bp, Artificial Sequence
  Synthetic probe
agctcctccagggcatcaatgttc

SEQ ID NO: 1819 - DNA, 24 bp, Artificial Sequence
  Synthetic probe
ctgcaggcctacggcaaggactac

SEQ ID NO: 1820 - DNA, 24 bp, Artificial Sequence
  Synthetic probe
atccgctccatattggctgtccag

SEQ ID NO: 1821 - DNA, 24 bp, Artificial Sequence
  Synthetic probe
agagtgactcccgttgtcccaagg

SEQ ID NO: 1822 - DNA, 26 bp, Artificial Sequence
  Synthetic probe
ctcagggcccaccattgaagaggttg

SEQ ID NO: 1823 - DNA, 24 bp, Artificial Sequence
  Synthetic probe
cgcacttttctgagcagacgtcca

SEQ ID NO: 1824 - DNA, 23 bp, Artificial Sequence
  Synthetic probe
cagctccgtgcctctagaggcct

SEQ ID NO: 1825 - DNA, 24 bp, Artificial Sequence
  Synthetic probe
tgaggactcccaggacagctctga

SEQ ID NO: 1826 - DNA, 21 bp, Artificial Sequence
  Synthetic probe
cgatgctaccctggctggcag

SEQ ID NO: 1827 - DNA, 24 bp, Artificial Sequence
  Synthetic probe
tcttcacacgacccacctacagcc

SEQ ID NO: 1828 - DNA, 24 bp, Artificial Sequence
  Synthetic probe
tgggacaggaacctcccagatctc

SEQ ID NO: 1829 - DNA, 20 bp, Artificial Sequence
  Synthetic probe
ccggcgcccaacgtgattct

SEQ ID NO: 1830 - DNA, 21 bp, Artificial Sequence
  Synthetic probe
ttgcccacagccaccaaagtg

SEQ ID NO: 1831 - DNA, 24 bp, Artificial Sequence
  Synthetic probe
cagaggatccgactgttgccagtc

SEQ ID NO: 1832 - DNA, 26 bp, Artificial Sequence
  Synthetic probe
tggagattctccagcacgtcatcgac

SEQ ID NO: 1833 - DNA, 22 bp, Artificial Sequence
  Synthetic probe
tgcccagcatcccccagaacaa

SEQ ID NO: 1834 - DNA, 24 bp, Artificial Sequence
  Synthetic probe
tcacagtccttcgctcctgagcac

SEQ ID NO: 1835 - DNA, 22 bp, Artificial Sequence
  Synthetic probe
cagacccaatggagcccaggat

SEQ ID NO: 1836 - DNA, 24 bp, Artificial Sequence
  Synthetic probe
tgtattgcgcacccctcaagcctg

SEQ ID NO: 1837 - DNA, 28 bp, Artificial Sequence
  Synthetic probe
cgcgtcataccaaaatctccgattttga

SEQ ID NO: 1838 - DNA, 24 bp, Artificial Sequence
  Synthetic probe
taccccgtgggcaagttcttccaa

SEQ ID NO: 1839 - DNA, 20 bp, Artificial Sequence
  Synthetic probe
cttccggccagcactgcctc

SEQ ID NO: 1840 - DNA, 24 bp, Artificial Sequence
  Synthetic probe
acaccacagaaggctgtgagctcc

SEQ ID NO: 1841 - DNA, 24 bp, Artificial Sequence
  Synthetic probe
cccgtcaacgtactccatgcctgg

SEQ ID NO: 1842 - DNA, 25 bp, Artificial Sequence
  Synthetic probe
atccaggcacctctaccacgccctc

SEQ ID NO: 1843 - DNA, 23 bp, Artificial Sequence
  Synthetic probe
ctctggtcctcatccaggtgcgc

SEQ ID NO: 1844 - DNA, 22 bp, Artificial Sequence
  Synthetic probe
tgacttccaagctggccgtggc

SEQ ID NO: 1845 - DNA, 22 bp, Artificial Sequence
  Synthetic probe
ctgctccacggccttgctcttg

SEQ ID NO: 1846 - DNA, 26 bp, Artificial Sequence
  Synthetic probe
cctgtgatcaacagtacccgtatggg

SEQ ID NO: 1847 - DNA, 24 bp, Artificial Sequence
  Synthetic probe
cagctatgctggtaggctcctgcc

SEQ ID NO: 1848 - DNA, 24 bp, Artificial Sequence
  Synthetic probe
tgcccacagaccttccaggagaat

SEQ ID NO: 1849 - DNA, 27 bp, Artificial Sequence
  Synthetic probe
ccagattggaagcatccatctttttca

SEQ ID NO: 1850 - DNA, 25 bp, Artificial Sequence
  Synthetic probe
catattgcccagtggtcacctcaca

SEQ ID NO: 1851 - DNA, 22 bp, Artificial Sequence
  Synthetic probe
caggtcctatcgtggcccctga

SEQ ID NO: 1852 - DNA, 25 bp, Artificial Sequence
  Synthetic probe
ctcattgtactctagcacgtgccgc

SEQ ID NO: 1853 - DNA, 24 bp, Artificial Sequence
  Synthetic probe
acatatgccatggtgatgcatccc

SEQ ID NO: 1854 - DNA, 25 bp, Artificial Sequence
  Synthetic probe
acgtccgggtcctcactgtccttcc

SEQ ID NO: 1855 - DNA, 23 bp, Artificial Sequence
  Synthetic probe
agctaagctgccatttgtcaccg

SEQ ID NO: 1856 - DNA, 24 bp, Artificial Sequence
  Synthetic probe
agttcctcaatgaggcctcggtca

SEQ ID NO: 1857 - DNA, 24 bp, Artificial Sequence
  Synthetic probe
ccgtggcatggtctacctcctgtt

SEQ ID NO: 1858 - DNA, 24 bp, Artificial Sequence
  Synthetic probe
aaagcctctagtccctgcggaacg

SEQ ID NO: 1859 - DNA, 24 bp, Artificial Sequence
  Synthetic probe
cactccagacctcgcttagcatgg

SEQ ID NO: 1860 - DNA, 24 bp, Artificial Sequence
  Synthetic probe
cgatcctgcatctgtaaatcgccc

SEQ ID NO: 1861 - DNA, 24 bp, Artificial Sequence
  Synthetic probe
tctgagccttgtcctctatccggc

SEQ ID NO: 1862 - DNA, 24 bp, Artificial Sequence
  Synthetic probe
tcgccatcttttgtgggattcctt

SEQ ID NO: 1863 - DNA, 21 bp, Artificial Sequence
  Synthetic probe
cagccaggacctggccatccg

SEQ ID NO: 1864 - DNA, 24 bp, Artificial Sequence
  Synthetic probe
ccgacagccacagaataacccaaa

SEQ ID NO: 1865 - DNA, 30 bp, Artificial Sequence
  Synthetic probe
tgctaatgtaaggcatcacagtcttttcca

SEQ ID NO: 1866 - DNA, 28 bp, Artificial Sequence
  Synthetic probe
aaatacctgcaaccgttactgccgtgac

SEQ ID NO: 1867 - DNA, 24 bp, Artificial Sequence
  Synthetic probe
caccaacctgtacccgtattgcga

SEQ ID NO: 1868 - DNA, 27 bp, Artificial Sequence
  Synthetic probe
tgctatgtttctacaaaaccgccaagg

SEQ ID NO: 1869 - DNA, 24 bp, Artificial Sequence
  Synthetic probe
actcgatttcccagccaaccacag

SEQ ID NO: 1870 - DNA, 29 bp, Artificial Sequence
  Synthetic probe
tgtatcttgttgagctatccaaactgccc

SEQ ID NO: 1871 - DNA, 24 bp, Artificial Sequence
  Synthetic probe
tcactccgcaggtcaggtgtcttc

SEQ ID NO: 1872 - DNA, 24 bp, Artificial Sequence
  Synthetic probe
caggcatgcagtgttcttggctgt

SEQ ID NO: 1873 - DNA, 23 bp, Artificial Sequence
  Synthetic probe
ccacttgtcgaaccaccgctcgt

SEQ ID NO: 1874 - DNA, 24 bp, Artificial Sequence
  Synthetic probe
tggaggtagctgcaatcaacccaa

SEQ ID NO: 1875 - DNA, 24 bp, Artificial Sequence
  Synthetic probe
cctgaggacatcaactacgcgtcg

SEQ ID NO: 1876 - DNA, 29 bp, Artificial Sequence
  Synthetic probe
catctcgcttatccaacaatgacttggca

SEQ ID NO: 1877 - DNA, 24 bp, Artificial Sequence
  Synthetic probe
cctgagggatctgtctcactggca

SEQ ID NO: 1878 - DNA, 24 bp, Artificial Sequence
  Synthetic probe
acccacatggtgacacagctctcc

SEQ ID NO: 1879 - DNA, 25 bp, Artificial Sequence
  Synthetic probe
tgtctcaaaatgccagccttctgaa

SEQ ID NO: 1880 - DNA, 24 bp, Artificial Sequence
  Synthetic probe
ctcatggacatcaagtcgcggctg

SEQ ID NO: 1881 - DNA, 28 bp, Artificial Sequence
  Synthetic probe
ccagtcaacatctctgttgtcacaagca

SEQ ID NO: 1882 - DNA, 24 bp, Artificial Sequence
  Synthetic probe
atgttgtcgatctcagcctgcagc

SEQ ID NO: 1883 - DNA, 24 bp, Artificial Sequence
  Synthetic probe
atctacgttgtccagctgccagcc

SEQ ID NO: 1884 - DNA, 24 bp, Artificial Sequence
  Synthetic probe
ctgattcctcaggtccttggcctg

SEQ ID NO: 1885 - DNA, 24 bp, Artificial Sequence
  Synthetic probe
ctctccatcgaggaaggcaaatcc

SEQ ID NO: 1886 - DNA, 24 bp, Artificial Sequence
  Synthetic probe
caagtgcctgtaccacacggaagg

SEQ ID NO: 1887 - DNA, 23 bp, Artificial Sequence
  Synthetic probe
ccactcgccatactgggtgcagt

SEQ ID NO: 1888 - DNA, 28 bp, Artificial Sequence
  Synthetic probe
aggtcttatcagcacagtctccgcctcc

SEQ ID NO: 1889 - DNA, 24 bp, Artificial Sequence
  Synthetic probe
tcctgaccctctgcagctcctaca

SEQ ID NO: 1890 - DNA, 24 bp, Artificial Sequence
  Synthetic probe
aaagctgtcctcgtcgtcaatgcc

SEQ ID NO: 1891 - DNA, 24 bp, Artificial Sequence
  Synthetic probe
agtgtaccatggtcacccagcacg

SEQ ID NO: 1892 - DNA, 27 bp, Artificial Sequence
  Synthetic probe
tctgccaaatctgctacagagagtcca

SEQ ID NO: 1893 - DNA, 21 bp, Artificial Sequence
  Synthetic probe
cccgggaacatcctcctggac

SEQ ID NO: 1894 - DNA, 25 bp, Artificial Sequence
  Synthetic probe
acccagataacgcatcatggagcga

SEQ ID NO: 1895 - DNA, 24 bp, Artificial Sequence
  Synthetic probe
cttccaccgtgtggacaccatctc

SEQ ID NO: 1896 - DNA, 24 bp, Artificial Sequence
  Synthetic probe
tgcctccctgtcgcaccagtacta

SEQ ID NO: 1897 - DNA, 22 bp, Artificial Sequence
  Synthetic probe
cagccccccaactgacctcatc

SEQ ID NO: 1898 - DNA, 24 bp, Artificial Sequence
  Synthetic probe
cgctacttcctgaaggccatcgac

SEQ ID NO: 1899 - DNA, 24 bp, Artificial Sequence
  Synthetic probe
caggctcagcaagctgaacacctg

SEQ ID NO: 1900 - DNA, 24 bp, Artificial Sequence
  Synthetic probe
cgggcatccaaccagtagagcttt

SEQ ID NO: 1901 - DNA, 22 bp, Artificial Sequence
  Synthetic probe
ccactgcaaattcgacatccgc

SEQ ID NO: 1902 - DNA, 24 bp, Artificial Sequence
  Synthetic probe
ctagaagctgccatcttgccatgg

SEQ ID NO: 1903 - DNA, 24 bp, Artificial Sequence
  Synthetic probe
cacggacaaccctctttgcacaag

SEQ ID NO: 1904 - DNA, 22 bp, Artificial Sequence
  Synthetic probe
tccatcttgccattcacgccgc

SEQ ID NO: 1905 - DNA, 23 bp, Artificial Sequence
  Synthetic probe
tgcattccagcctcccatttcca

SEQ ID NO: 1906 - DNA, 24 bp, Artificial Sequence
  Synthetic probe
acctccaactgctgtgctgtctgc

SEQ ID NO: 1907 - DNA, 24 bp, Artificial Sequence
  Synthetic probe
caaaatccagacaagacccccgaa

SEQ ID NO: 1908 - DNA, 30 bp, Artificial Sequence
  Synthetic probe
tctcaaagtcgtcatccttcagttctccca

SEQ ID NO: 1909 - DNA, 24 bp, Artificial Sequence
  Synthetic probe
cacatcttcacatggccctccttg

SEQ ID NO: 1910 - DNA, 24 bp, Artificial Sequence
  Synthetic probe
accaaccagtccacgctccaaggg

SEQ ID NO: 1911 - DNA, 24 bp, Artificial Sequence
  Synthetic probe
cccatgctggcttcttcaacaaag

SEQ ID NO: 1912 - DNA, 28 bp, Artificial Sequence
  Synthetic probe
agctgacaacagtgtgaacgaccagacc

SEQ ID NO: 1913 - DNA, 24 bp, Artificial Sequence
  Synthetic probe
ctttccagcacctggcctgtctct

SEQ ID NO: 1914 - DNA, 24 bp, Artificial Sequence
  Synthetic probe
acagctcattgttgtcacgccgga

SEQ ID NO: 1915 - DNA, 27 bp, Artificial Sequence
  Synthetic probe
tggcctttctgtctacaaggatcacca

SEQ ID NO: 1916 - DNA, 30 bp, Artificial Sequence
  Synthetic probe
caggtttcataccaacacaggcttcagcac

SEQ ID NO: 1917 - DNA, 21 bp, Artificial Sequence
  Synthetic probe
tgccccagtcacctgctgtta

SEQ ID NO: 1918 - DNA, 23 bp, Artificial Sequence
  Synthetic probe
cgagctggatccaaacccttcag

SEQ ID NO: 1919 - DNA, 24 bp, Artificial Sequence
  Synthetic probe
atcacacgcaccccagttctcaaa

SEQ ID NO: 1920 - DNA, 23 bp, Artificial Sequence
  Synthetic probe
cttacaccagcatcaagatccgg

SEQ ID NO: 1921 - DNA, 20 bp, Artificial Sequence
  Synthetic probe
cagccctttggggaagctgg

SEQ ID NO: 1922 - DNA, 22 bp, Artificial Sequence
  Synthetic probe
tttgacaccccttccccagcca

SEQ ID NO: 1923 - DNA, 24 bp, Artificial Sequence
  Synthetic probe
cgaggcctcagagggcaacattac

SEQ ID NO: 1924 - DNA, 24 bp, Artificial Sequence
  Synthetic probe
ctattacgacatgaacgcggccaa

SEQ ID NO: 1925 - DNA, 30 bp, Artificial Sequence
  Synthetic probe
agcaagatttcctccaggtccatcaaaagg

SEQ ID NO: 1926 - DNA, 22 bp, Artificial Sequence
  Synthetic probe
agctcgcccagttccgcctttc

SEQ ID NO: 1927 - DNA, 24 bp, Artificial Sequence
  Synthetic probe
cctgaggaaggcacacttgctcct

SEQ ID NO: 1928 - DNA, 24 bp, Artificial Sequence
  Synthetic probe
ctgggagcatggcgatggataccc

SEQ ID NO: 1929 - DNA, 28 bp, Artificial Sequence
  Synthetic probe
cctgtatgctgcaactcatgaacttggc

SEQ ID NO: 1930 - DNA, 24 bp, Artificial Sequence
  Synthetic probe
acaggtattcctctgccagctgcc

SEQ ID NO: 1931 - DNA, 29 bp, Artificial Sequence
  Synthetic probe
acctgatacgtcttggtcttcatcgccat

SEQ ID NO: 1932 - DNA, 25 bp, Artificial Sequence
  Synthetic probe
ctgccattcgacatgactgcaattt

SEQ ID NO: 1933 - DNA, 26 bp, Artificial Sequence
  Synthetic probe
tctgtcctggctggagtcgctttcat

SEQ ID NO: 1934 - DNA, 24 bp, Artificial Sequence
  Synthetic probe
cggagtccagtgttttcccactta

SEQ ID NO: 1935 - DNA, 29 bp, Artificial Sequence
  Synthetic probe
caagaagatttacttcgtcgattcccaga

SEQ ID NO: 1936 - DNA, 24 bp, Artificial Sequence
  Synthetic probe
tcccaattgtcgcttcttctgcag

SEQ ID NO: 1937 - DNA, 26 bp, Artificial Sequence
  Synthetic probe
ccgttaccagctggaaattcctgaga

SEQ ID NO: 1938 - DNA, 24 bp, Artificial Sequence
  Synthetic probe
atgagcctttgcagacacagccct

SEQ ID NO: 1939 - DNA, 23 bp, Artificial Sequence
  Synthetic probe
cccgaggcgagactagagttccc

SEQ ID NO: 1940 - DNA, 23 bp, Artificial Sequence
  Synthetic probe
ccgaggtgagactggagttccca

SEQ ID NO: 1941 - DNA, 24 bp, Artificial Sequence
  Synthetic probe
cacctcctgcaagaagagctgctg

SEQ ID NO: 1942 - DNA, 23 bp, Artificial Sequence
  Synthetic probe
ctctggccttccgagaaggtacc

SEQ ID NO: 1943 - DNA, 25 bp, Artificial Sequence
  Synthetic probe
cgcacctttccggtcttgacatcct

SEQ ID NO: 1944 - DNA, 23 bp, Artificial Sequence
  Synthetic probe
tcaccctggagatcagctcccga

SEQ ID NO: 1945 - DNA, 24 bp, Artificial Sequence
  Synthetic probe
cagcattgtctgtcctccctggca

SEQ ID NO: 1946 - DNA, 26 bp, Artificial Sequence
  Synthetic probe
ctcttctgcgtggtggtcaaccccta

SEQ ID NO: 1947 - DNA, 24 bp, Artificial Sequence
  Synthetic probe
atttgcaatctccacactggcgct

SEQ ID NO: 1948 - DNA, 24 bp, Artificial Sequence
  Synthetic probe
cttccaagttctggctgcttgcag

SEQ ID NO: 1949 - DNA, 23 bp, Artificial Sequence
  Synthetic probe
aagcgcttctcaaagcccagcag

SEQ ID NO: 1950 - DNA, 24 bp, Artificial Sequence
  Synthetic probe
cgagaatcagtccccgtggagttc

SEQ ID NO: 1951 - DNA, 24 bp, Artificial Sequence
  Synthetic probe
cgggttcctaccccacagtcattc

SEQ ID NO: 1952 - DNA, 24 bp, Artificial Sequence
  Synthetic probe
aagctgtaaacatgagccgcacca

SEQ ID NO: 1953 - DNA, 21 bp, Artificial Sequence
  Synthetic probe
ctgagctctgcccggaccgct

SEQ ID NO: 1954 - DNA, 25 bp, Artificial Sequence
  Synthetic probe
cctgccctgtgactgcttgtaaagc

SEQ ID NO: 1955 - DNA, 24 bp, Artificial Sequence
  Synthetic probe
agcagattcaaagccaggcaccat

SEQ ID NO: 1956 - DNA, 24 bp, Artificial Sequence
  Synthetic probe
ccctctcctcatgcccagactctc

SEQ ID NO: 1957 - DNA, 24 bp, Artificial Sequence
  Synthetic probe
ctcaaggtccctttctgctcccct

SEQ ID NO: 1958 - DNA, 24 bp, Artificial Sequence
  Synthetic probe
tgtccctgggtcctctggtcaaac

SEQ ID NO: 1959 - DNA, 22 bp, Artificial Sequence
  Synthetic probe
ttcactcgcttcgccatcaccg

SEQ ID NO: 1960 - DNA, 19 bp, Artificial Sequence
  Synthetic probe
ccgctctgcagccgggaca

SEQ ID NO: 1961 - DNA, 24 bp, Artificial Sequence
  Synthetic probe
ccgtgttgcacagctcatcacact

SEQ ID NO: 1962 - DNA, 24 bp, Artificial Sequence
  Synthetic probe
accctgtggccctcatggtatctg

SEQ ID NO: 1963 - DNA, 28 bp, Artificial Sequence
  Synthetic probe
ttcccagagtgtctcacctccagcagag

SEQ ID NO: 1964 - DNA, 28 bp, Artificial Sequence
  Synthetic probe
aacaggcattttggacaacacattcttg

SEQ ID NO: 1965 - DNA, 24 bp, Artificial Sequence
  Synthetic probe
aggggctttttcctcaaccctgtg

SEQ ID NO: 1966 - DNA, 24 bp, Artificial Sequence
  Synthetic probe
ccttcagaaccctcatgctcctgg

SEQ ID NO: 1967 - DNA, 24 bp, Artificial Sequence
  Synthetic probe
ccttccattcccacccttccttct

SEQ ID NO: 1968 - DNA, 24 bp, Artificial Sequence
  Synthetic probe
atgaccaccccggctcgtatgtca

SEQ ID NO: 1969 - DNA, 24 bp, Artificial Sequence
  Synthetic probe
ccacgggtacttcaagttccaggg

SEQ ID NO: 1970 - DNA, 24 bp, Artificial Sequence
  Synthetic probe
tctgcctgatggccctagacaagc

SEQ ID NO: 1971 - DNA, 28 bp, Artificial Sequence
  Synthetic probe
tccccacagtagacacatatgatggccg

SEQ ID NO: 1972 - DNA, 20 bp, Artificial Sequence
  Synthetic probe
cggcggcagaccagcatgac

SEQ ID NO: 1973 - DNA, 23 bp, Artificial Sequence
  Synthetic probe
ccgggacttggagaagcactgca

SEQ ID NO: 1974 - DNA, 25 bp, Artificial Sequence
  Synthetic probe
aagtcctgggtgcttctgacgcaca

SEQ ID NO: 1975 - DNA, 24 bp, Artificial Sequence
  Synthetic probe
atcctttgcagtgccctccagaaa

SEQ ID NO: 1976 - DNA, 22 bp, Artificial Sequence
  Synthetic probe
ctcggtgttggccatgctccag

SEQ ID NO: 1977 - DNA, 24 bp, Artificial Sequence
  Synthetic probe
acatctgtcaaggagcctccagcc

SEQ ID NO: 1978 - DNA, 24 bp, Artificial Sequence
  Synthetic probe
tccaaggtcttcccggctacttca

SEQ ID NO: 1979 - DNA, 26 bp, Artificial Sequence
  Synthetic probe
tggtagcagaattgccttttcaacca

SEQ ID NO: 1980 - DNA, 24 bp, Artificial Sequence
  Synthetic probe
tccccttctccaactgtgtctcca

SEQ ID NO: 1981 - DNA, 24 bp, Artificial Sequence
  Synthetic probe
cagccaaactgcccaagatcttcc

SEQ ID NO: 1982 - DNA, 24 bp, Artificial Sequence
  Synthetic probe
atcccagcaggcctcgttgatgag

SEQ ID NO: 1983 - DNA, 24 bp, Artificial Sequence
  Synthetic probe
cacaccttcctcagaatggacccc

SEQ ID NO: 1984 - DNA, 24 bp, Artificial Sequence
  Synthetic probe
tctccaacacatcggagagcttcg

SEQ ID NO: 1985 - DNA, 28 bp, Artificial Sequence
  Synthetic probe
tcgcgcagtctctctaagtcatgatctc

SEQ ID NO: 1986 - DNA, 22 bp, Artificial Sequence
  Synthetic probe
tggtggcggtcactccctctgc

SEQ ID NO: 1987 - DNA, 21 bp, Artificial Sequence
  Synthetic probe
tctcctgccgatgcccctagg

SEQ ID NO: 1988 - DNA, 27 bp, Artificial Sequence
  Synthetic probe
ccctgacaccggtctttggtctcaact

SEQ ID NO: 1989 - DNA, 25 bp, Artificial Sequence
  Synthetic probe
tccaggtcaacttttgacttccggt

SEQ ID NO: 1990 - DNA, 23 bp, Artificial Sequence
  Synthetic probe
cccaagacccgaccaagcactag

SEQ ID NO: 1991 - DNA, 24 bp, Artificial Sequence
  Synthetic probe
atcaatgtccctgtccgagtgctg

SEQ ID NO: 1992 - DNA, 26 bp, Artificial Sequence
  Synthetic probe
tgcccttcttgcttggacagtttaca

SEQ ID NO: 1993 - DNA, 24 bp, Artificial Sequence
  Synthetic probe
ctcgctgcagagcttgtcaaggtc

SEQ ID NO: 1994 - DNA, 20 bp, Artificial Sequence
  Synthetic probe
tccgtcccaggcacatcacc

SEQ ID NO: 1995 - DNA, 24 bp, Artificial Sequence
  Synthetic probe
cagatccctgatgtcgaagggctc

SEQ ID NO: 1996 - DNA, 24 bp, Artificial Sequence
  Synthetic probe
ctccccaccttgactctttgtccg

SEQ ID NO: 1997 - DNA, 24 bp, Artificial Sequence
  Synthetic probe
atcttctcagacgtcccgagccag

SEQ ID NO: 1998 - DNA, 28 bp, Artificial Sequence
  Synthetic probe
tcctcctgaaacgagctgtgtctgactt

SEQ ID NO: 1999 - DNA, 30 bp, Artificial Sequence
  Synthetic probe
tgtgctgtgactggacttaacaaatagcct

SEQ ID NO: 2000 - DNA, 24 bp, Artificial Sequence
  Synthetic probe
tcctgcttctcgggatacagacca

SEQ ID NO: 2001 - DNA, 24 bp, Artificial Sequence
  Synthetic probe
ccttggaccacaaatccagctcag

SEQ ID NO: 2002 - DNA, 24 bp, Artificial Sequence
  Synthetic probe
tagataccagggccacgtgctacg

SEQ ID NO: 2003 - DNA, 22 bp, Artificial Sequence
  Synthetic probe
cattgactgccgaggccccatg

SEQ ID NO: 2004 - DNA, 20 bp, Artificial Sequence
  Synthetic probe
tgccaggcctgggactctca

SEQ ID NO: 2005 - DNA, 24 bp, Artificial Sequence
  Synthetic probe
agatctgcagcttgccacatcagc

SEQ ID NO: 2006 - DNA, 24 bp, Artificial Sequence
  Synthetic probe
tccagccttttcgtggtgactcaa

SEQ ID NO: 2007 - DNA, 24 bp, Artificial Sequence
  Synthetic probe
caccattagccaccagcaactgct

SEQ ID NO: 2008 - DNA, 24 bp, Artificial Sequence
  Synthetic probe
aatccgagttgagatgccactccg

SEQ ID NO: 2009 - DNA, 24 bp, Artificial Sequence
  Synthetic probe
accagggctccttgagcaaatcct

SEQ ID NO: 2010 - DNA, 25 bp, Artificial Sequence
  Synthetic probe
ttccagtgcattgaacttcacagca

SEQ ID NO: 2011 - DNA, 24 bp, Artificial Sequence
  Synthetic probe
ccttcctcaacttttccttgccca

SEQ ID NO: 2012 - DNA, 24 bp, Artificial Sequence
  Synthetic probe
tttcttgcagtttgacccagcacc

SEQ ID NO: 2013 - DNA, 23 bp, Artificial Sequence
  Synthetic probe
ctacatctgggcccgctttaggg

SEQ ID NO: 2014 - DNA, 25 bp, Artificial Sequence
  Synthetic probe
cagcctctgcggaatggatcacact

SEQ ID NO: 2015 - DNA, 24 bp, Artificial Sequence
  Synthetic probe
ccagaccatggaccgcctgtactt

SEQ ID NO: 2016 - DNA, 26 bp, Artificial Sequence
  Synthetic probe
ccctttctcacccacctcatctgcac

SEQ ID NO: 2017 - DNA, 24 bp, Artificial Sequence
  Synthetic probe
tcctgttaacatcccaagcccaca

SEQ ID NO: 2018 - DNA, 26 bp, Artificial Sequence
  Synthetic probe
cccaacatattttatagtggcccagc

SEQ ID NO: 2019 - DNA, 23 bp, Artificial Sequence
  Synthetic probe
acccgaggctgtgtctccaacac

SEQ ID NO: 2020 - DNA, 24 bp, Artificial Sequence
  Synthetic probe
cttcctcgttcagatccagaggcc

SEQ ID NO: 2021 - DNA, 24 bp, Artificial Sequence
  Synthetic probe
ttgacatttccatgatcttggccg

SEQ ID NO: 2022 - DNA, 24 bp, Artificial Sequence
  Synthetic probe
tcctggatccaaagcaaggtgaca

SEQ ID NO: 2023 - DNA, 24 bp, Artificial Sequence
  Synthetic probe
ccaaagcacagatcttccgcactg

SEQ ID NO: 2024 - DNA, 24 bp, Artificial Sequence
  Synthetic probe
caaggtcataggcctcttcagggc

SEQ ID NO: 2025 - DNA, 24 bp, Artificial Sequence
  Synthetic probe
tggtccacaccggcagctgtaata

SEQ ID NO: 2026 - DNA, 29 bp, Artificial Sequence
  Synthetic probe
cctttccagctttacagtgaattgctgca

SEQ ID NO: 2027 - DNA, 24 bp, Artificial Sequence
  Synthetic probe
ccttctccagggacagaagcagga

SEQ ID NO: 2028 - DNA, 22 bp, Artificial Sequence
  Synthetic probe
ccagtgccagtgtccagcggct

SEQ ID NO: 2029 - DNA, 24 bp, Artificial Sequence
  Synthetic probe
accaggcccgtcacattctcgtac

SEQ ID NO: 2030 - DNA, 23 bp, Artificial Sequence
  Synthetic probe
ctccgcaaaccaacctcctggct

SEQ ID NO: 2031 - DNA, 24 bp, Artificial Sequence
  Synthetic probe
ttcctctgctctggggctctcttg

SEQ ID NO: 2032 - DNA, 26 bp, Artificial Sequence
  Synthetic probe
tctcagtaatttacaggcgtccacag

SEQ ID NO: 2033 - DNA, 24 bp, Artificial Sequence
  Synthetic probe
atgcacacagactcatccgccact

SEQ ID NO: 2034 - DNA, 24 bp, Artificial Sequence
  Synthetic probe
caacatctccaaaagcccgagtgc

SEQ ID NO: 2035 - DNA, 24 bp, Artificial Sequence
  Synthetic probe
caccattagccatgtctcacccga

SEQ ID NO: 2036 - DNA, 22 bp, Artificial Sequence
  Synthetic probe
cacacgggtgcctggttctcca

SEQ ID NO: 2037 - DNA, 24 bp, Artificial Sequence
  Synthetic probe
ttttgccgtccccatctttgtctc

SEQ ID NO: 2038 - DNA, 24 bp, Artificial Sequence
  Synthetic probe
actgggacggcgacaccatctact

SEQ ID NO: 2039 - DNA, 23 bp, Artificial Sequence
  Synthetic probe
cgttcttggtcctgtcccttgga

SEQ ID NO: 2040 - DNA, 24 bp, Artificial Sequence
  Synthetic probe
ctttcagccaggcagatgcacttg

SEQ ID NO: 2041 - DNA, 26 bp, Artificial Sequence
  Synthetic probe
tccaggatgcctgttagttctcagca

SEQ ID NO: 2042 - DNA, 28 bp, Artificial Sequence
  Synthetic probe
tgctgtcctgtcggtctcagtacgttca

SEQ ID NO: 2043 - DNA, 26 bp, Artificial Sequence
  Synthetic probe
tgcaccaggtataccccagaacaaga

SEQ ID NO: 2044 - DNA, 24 bp, Artificial Sequence
  Synthetic probe
caccaccaagaactttcgcagcag

SEQ ID NO: 2045 - DNA, 24 bp, Artificial Sequence
  Synthetic probe
cccttacggattcctggagggaac

SEQ ID NO: 2046 - DNA, 24 bp, Artificial Sequence
  Synthetic probe
cgcccatcaggagatgcctttatc

SEQ ID NO: 2047 - DNA, 25 bp, Artificial Sequence
  Synthetic probe
tcctcttcctttctgctagcctggc

SEQ ID NO: 2048 - DNA, 24 bp, Artificial Sequence
  Synthetic probe
aacatcagcgtggcctacaggctc

SEQ ID NO: 2049 - DNA, 25 bp, Artificial Sequence
  Synthetic probe
agcagcatctgaatgcacaaatgct

SEQ ID NO: 2050 - DNA, 30 bp, Artificial Sequence
  Synthetic probe
aatattgaccacttcactaaggacatcaca

SEQ ID NO: 2051 - DNA, 28 bp, Artificial Sequence
  Synthetic probe
tgtcactgtcctagaacaccctggagtt

SEQ ID NO: 2052 - DNA, 24 bp, Artificial Sequence
  Synthetic probe
ctttccaacccctggggaagacat

SEQ ID NO: 2053 - DNA, 19 bp, Artificial Sequence
  Synthetic probe
tccggttcgccatgtcccg

SEQ ID NO: 2054 - DNA, 24 bp, Artificial Sequence
  Synthetic probe
cagccacagaacagcctggttcac

SEQ ID NO: 2055 - DNA, 24 bp, Artificial Sequence
  Synthetic probe
ttttaagcctgactcctcaccgcg

SEQ ID NO: 2056 - DNA, 24 bp, Artificial Sequence
  Synthetic probe
tcactctctttgctggccaactgc

SEQ ID NO: 2057 - DNA, 23 bp, Artificial Sequence
  Synthetic probe
cccatcaacgtggagagcttgct

SEQ ID NO: 2058 - DNA, 24 bp, Artificial Sequence
  Synthetic probe
cctcaccccaacgcagccttagct

SEQ ID NO: 2059 - DNA, 24 bp, Artificial Sequence
  Synthetic probe
atcaccaacagcatgacctttgcg

SEQ ID NO: 2060 - DNA, 23 bp, Artificial Sequence
  Synthetic probe
tcgtatccgagggttcaacctcg

SEQ ID NO: 2061 - DNA, 24 bp, Artificial Sequence
  Synthetic probe
acccggagaatggacagacctcag

SEQ ID NO: 2062 - DNA, 24 bp, Artificial Sequence
  Synthetic probe
cacaccaaccaataatttcgcatt

SEQ ID NO: 2063 - DNA, 25 bp, Artificial Sequence
  Synthetic probe
cattggaattgccattagtcccagc

SEQ ID NO: 2064 - DNA, 25 bp, Artificial Sequence
  Synthetic probe
ccagcacagccagttaaaagatgca

SEQ ID NO: 2065 - DNA, 24 bp, Artificial Sequence
  Synthetic probe
ttggatctgcttgctgtccaaacc

SEQ ID NO: 2066 - DNA, 24 bp, Artificial Sequence
  Synthetic probe
cctccccgtctccattctcgtcta

SEQ ID NO: 2067 - DNA, 24 bp, Artificial Sequence
  Synthetic probe
cacgccatggaaaccatgatgttt

SEQ ID NO: 2068 - DNA, 27 bp, Artificial Sequence
  Synthetic probe
cacaagtactcctgccaagagggcgac

SEQ ID NO: 2069 - DNA, 24 bp, Artificial Sequence
  Synthetic probe
agcttctcacgggcctggttttct

SEQ ID NO: 2070 - DNA, 24 bp, Artificial Sequence
  Synthetic probe
tgctccctatgcctttccaagcat

SEQ ID NO: 2071 - DNA, 24 bp, Artificial Sequence
  Synthetic probe
agagactctgccatccctggagga

SEQ ID NO: 2072 - DNA, 24 bp, Artificial Sequence
  Synthetic probe
ctgtccaccaaatgcacgctgata

SEQ ID NO: 2073 - DNA, 24 bp, Artificial Sequence
  Synthetic probe
cggagccctccaaactgatctgtc

SEQ ID NO: 2074 - DNA, 24 bp, Artificial Sequence
  Synthetic probe
cctgtgaagctcccactgagtcca

SEQ ID NO: 2075 - DNA, 24 bp, Artificial Sequence
  Synthetic probe
tgcccactcagtgctgatcatgac

SEQ ID NO: 2076 - DNA, 24 bp, Artificial Sequence
  Synthetic probe
cacaaactgacactggggcccata

SEQ ID NO: 2077 - DNA, 20 bp, Artificial Sequence
  Synthetic probe
cactgtggtgctggcggtcc

SEQ ID NO: 2078 - DNA, 18 bp, Artificial Sequence
  Synthetic probe
tcgcgggaccaccggacc

SEQ ID NO: 2079 - DNA, 24 bp, Artificial Sequence
  Synthetic probe
cctccgtttcccagttgggtagaa

SEQ ID NO: 2080 - DNA, 22 bp, Artificial Sequence
  Synthetic probe
ctccccacagcgcatcgaggaa

SEQ ID NO: 2081 - DNA, 24 bp, Artificial Sequence
  Synthetic probe
agcctctggacccagaacatcacc

SEQ ID NO: 2082 - DNA, 24 bp, Artificial Sequence
  Synthetic probe
aggtccagagtcctggcccttgat

SEQ ID NO: 2083 - DNA, 22 bp, Artificial Sequence
  Synthetic probe
ctgctctgccagcttggccttc

SEQ ID NO: 2084 - DNA, 23 bp, Artificial Sequence
  Synthetic probe
tgtcctgtccttctgcaggaggc

SEQ ID NO: 2085 - DNA, 24 bp, Artificial Sequence
  Synthetic probe
agctgtgctcgtgtcctgctcttc

SEQ ID NO: 2086 - DNA, 24 bp, Artificial Sequence
  Synthetic probe
cctgtgttcttgctgagcaccctc

SEQ ID NO: 2087 - DNA, 24 bp, Artificial Sequence
  Synthetic probe
ttggtgagaatagccccctcctca

SEQ ID NO: 2088 - DNA, 24 bp, Artificial Sequence
  Synthetic probe
ccaatctctgcctcagttctgcca

SEQ ID NO: 2089 - DNA, 24 bp, Artificial Sequence
  Synthetic probe
cccccagtacttcctcgacaccaa

SEQ ID NO: 2090 - DNA, 22 bp, Artificial Sequence
  Synthetic probe
ccccgccaggatgaacacgtac

SEQ ID NO: 2091 - DNA, 24 bp, Artificial Sequence
  Synthetic probe
cagcatccacgcattgacacagac

SEQ ID NO: 2092 - DNA, 24 bp, Artificial Sequence
  Synthetic probe
ctctccatgctgtggtttgccact

SEQ ID NO: 2093 - DNA, 24 bp, Artificial Sequence
  Synthetic probe
acatcccaggcttcaccctgaatg

SEQ ID NO: 2094 - DNA, 24 bp, Artificial Sequence
  Synthetic probe
tcctgggcacccactatgaggtct

SEQ ID NO: 2095 - DNA, 24 bp, Artificial Sequence
  Synthetic probe
agatcacctcctcgaacccactcc

SEQ ID NO: 2096 - DNA, 24 bp, Artificial Sequence
  Synthetic probe
ccttctggcctgcctcatgaagat

SEQ ID NO: 2097 - DNA, 24 bp, Artificial Sequence
  Synthetic probe
cacagtcctgccccttgaaaccat

SEQ ID NO: 2098 - DNA, 25 bp, Artificial Sequence
  Synthetic probe
tctggattagagtcctgcagctcgc

SEQ ID NO: 2099 - DNA, 24 bp, Artificial Sequence
  Synthetic probe
ccagctgcagtagttcggagacca

SEQ ID NO: 2100 - DNA, 24 bp, Artificial Sequence
  Synthetic probe
tttgtcagcagtcacattgcccaa

SEQ ID NO: 2101 - DNA, 24 bp, Artificial Sequence
  Synthetic probe
cagtcaagcccaaattgtgcaagg

SEQ ID NO: 2102 - DNA, 22 bp, Artificial Sequence
  Synthetic probe
tggaccagcaccccattgacgg

SEQ ID NO: 2103 - DNA, 24 bp, Artificial Sequence
  Synthetic probe
acttcatcccaagccaggcctttc

SEQ ID NO: 2104 - DNA, 24 bp, Artificial Sequence
  Synthetic probe
taacagccctctggcaggagctct

SEQ ID NO: 2105 - DNA, 24 bp, Artificial Sequence
  Synthetic probe
tggtgacctgctcatagccagcat

SEQ ID NO: 2106 - DNA, 23 bp, Artificial Sequence
  Synthetic probe
ctgggtccggattgccctttcag

SEQ ID NO: 2107 - DNA, 25 bp, Artificial Sequence
  Synthetic probe
cagtccctacagatgccagaatccg

SEQ ID NO: 2108 - DNA, 25 bp, Artificial Sequence
  Synthetic probe
tggcagttttcttctgtcaccaaaa

SEQ ID NO: 2109 - DNA, 22 bp, Artificial Sequence
  Synthetic probe
tcctgggagagattgaccagca

SEQ ID NO: 2110 - DNA, 22 bp, Artificial Sequence
  Synthetic probe
cggttgctctgcacttcggcct

SEQ ID NO: 2111 - DNA, 23 bp, Artificial Sequence
  Synthetic probe
cagccaggacaacaatgcgacgg

SEQ ID NO: 2112 - DNA, 24 bp, Artificial Sequence
  Synthetic probe
ttctgctcacactgaacctgcacg

SEQ ID NO: 2113 - DNA, 24 bp, Artificial Sequence
  Synthetic probe
ttcttgaggatcttgacggccctc

SEQ ID NO: 2114 - DNA, 24 bp, Artificial Sequence
  Synthetic probe
ctctgtggcaccctggactacctg

SEQ ID NO: 2115 - DNA, 24 bp, Artificial Sequence
  Synthetic probe
acctctttccctcagatggggagc

SEQ ID NO: 2116 - DNA, 25 bp, Artificial Sequence
  Synthetic probe
atcctcctgaagcccttttcgcagc

SEQ ID NO: 2117 - DNA, 24 bp, Artificial Sequence
  Synthetic probe
cccaggaggagcagttaaaccagc

SEQ ID NO: 2118 - DNA, 24 bp, Artificial Sequence
  Synthetic probe
ttcccatgaactgcatcaccttcc

SEQ ID NO: 2119 - DNA, 28 bp, Artificial Sequence
  Synthetic probe
tgccttcttcctccctcacttctcacct

SEQ ID NO: 2120 - DNA, 23 bp, Artificial Sequence
  Synthetic probe
cccccagttccttgatctccacc

SEQ ID NO: 2121 - DNA, 24 bp, Artificial Sequence
  Synthetic probe
cccatagtcctcagccgccttcag

SEQ ID NO: 2122 - DNA, 24 bp, Artificial Sequence
  Synthetic probe
caccagctgcccaccaatgtagag

SEQ ID NO: 2123 - DNA, 24 bp, Artificial Sequence
  Synthetic probe
cgcatcgaatcacatgggacagat

SEQ ID NO: 2124 - DNA, 24 bp, Artificial Sequence
  Synthetic probe
tccccgctacacagtgcttgactc

SEQ ID NO: 2125 - DNA, 25 bp, Artificial Sequence
  Synthetic probe
agctcggaccacgtactgctccctg

SEQ ID NO: 2126 - DNA, 21 bp, Artificial Sequence
  Synthetic probe
accaaacgcaggagcagcccg

SEQ ID NO: 2127 - DNA, 24 bp, Artificial Sequence
  Synthetic probe
atggacgcgccttgctcttactgt

SEQ ID NO: 2128 - DNA, 24 bp, Artificial Sequence
  Synthetic probe
ctggtcgtcgacattctgcacctc

SEQ ID NO: 2129 - DNA, 24 bp, Artificial Sequence
  Synthetic probe
atggaacccagctcaatgctgtga

SEQ ID NO: 2130 - DNA, 27 bp, Artificial Sequence
  Synthetic probe
ttggcctgtaatcacctgtgcagcctt

SEQ ID NO: 2131 - DNA, 24 bp, Artificial Sequence
  Synthetic probe
tctctccatctttaatggggcccc

SEQ ID NO: 2132 - DNA, 21 bp, Artificial Sequence
  Synthetic probe
tcctgagcccgaggaagtccc

SEQ ID NO: 2133 - DNA, 24 bp, Artificial Sequence
  Synthetic probe
ccttctccccagggaccttttcat

SEQ ID NO: 2134 - DNA, 24 bp, Artificial Sequence
  Synthetic probe
agcaatgacagctgccagttccac

SEQ ID NO: 2135 - DNA, 24 bp, Artificial Sequence
  Synthetic probe
ttctgggctcctgattgctcaagc

SEQ ID NO: 2136 - DNA, 24 bp, Artificial Sequence
  Synthetic probe
cacctaatgacagtgcgctcctcg

SEQ ID NO: 2137 - DNA, 22 bp, Artificial Sequence
  Synthetic probe
ccaatgagctgaggcggcctcc

SEQ ID NO: 2138 - DNA, 26 bp, Artificial Sequence
  Synthetic probe
atcctgcccggagtggaagctgaagc

SEQ ID NO: 2139 - DNA, 22 bp, Artificial Sequence
  Synthetic probe
ccctgggacaccctgagcacca

SEQ ID NO: 2140 - DNA, 24 bp, Artificial Sequence
  Synthetic probe
ccaagaacgagtgtctctggaccg

SEQ ID NO: 2141 - DNA, 26 bp, Artificial Sequence
  Synthetic probe
caaatggcttcctctggaaggtccca

SEQ ID NO: 2142 - DNA, 24 bp, Artificial Sequence
  Synthetic probe
cttgcccaatttcattaaggccca

SEQ ID NO: 2143 - DNA, 24 bp, Artificial Sequence
  Synthetic probe
tctggtgactgccattcatgctga

SEQ ID NO: 2144 - DNA, 24 bp, Artificial Sequence
  Synthetic probe
ccgcctgcttatcctacccaatga

SEQ ID NO: 2145 - DNA, 24 bp, Artificial Sequence
  Synthetic probe
cgtctccgttttcttcagcttggc

SEQ ID NO: 2146 - DNA, 24 bp, Artificial Sequence
  Synthetic probe
cgctgagatcaatcggcccgacta

SEQ ID NO: 2147 - DNA, 24 bp, Artificial Sequence
  Synthetic probe
caacccacgcgacttgtgtgtctt

SEQ ID NO: 2148 - DNA, 24 bp, Artificial Sequence
  Synthetic probe
attgctacaacccacacgcaaagg

SEQ ID NO: 2149 - DNA, 24 bp, Artificial Sequence
  Synthetic probe
aacggtaggaagcgctccttcacc

SEQ ID NO: 2150 - DNA, 24 bp, Artificial Sequence
  Synthetic probe
aggcatcccagggactcagttcac

SEQ ID NO: 2151 - DNA, 24 bp, Artificial Sequence
  Synthetic probe
agggcctaatgcacgcactaaagc

SEQ ID NO: 2152 - DNA, 24 bp, Artificial Sequence
  Synthetic probe
tgccagacagctatggcctctcac

SEQ ID NO: 2153 - DNA, 24 bp, Artificial Sequence
  Synthetic probe
ttgtcttgtttctcgcccctcaca

SEQ ID NO: 2154 - DNA, 25 bp, Artificial Sequence
  Synthetic probe
tccccaaagacatggaccttcttcc

SEQ ID NO: 2155 - DNA, 24 bp, Artificial Sequence
  Synthetic probe
tgccttcccgaaacactgatgaga

SEQ ID NO: 2156 - DNA, 24 bp, Artificial Sequence
  Synthetic probe
aatcctactttgagcccgttcccg

SEQ ID NO: 2157 - DNA, 26 bp, Artificial Sequence
  Synthetic probe
catatggactttgactcagctgtggc

SEQ ID NO: 2158 - DNA, 24 bp, Artificial Sequence
  Synthetic probe
ttccctactgagccaccttctctg

SEQ ID NO: 2159 - DNA, 23 bp, Artificial Sequence
  Synthetic probe
acagcctgccactcatcacagcc

SEQ ID NO: 2160 - DNA, 26 bp, Artificial Sequence
  Synthetic probe
aagtacacgtaagttacagccacaca

SEQ ID NO: 2161 - DNA, 22 bp, Artificial Sequence
  Synthetic probe
catcgccagctacgccctgctc

SEQ ID NO: 2162 - DNA, 24 bp, Artificial Sequence
  Synthetic probe
tttcctcatcgttcagccgatgtc

SEQ ID NO: 2163 - DNA, 24 bp, Artificial Sequence
  Synthetic probe
taccagtccagctgccaaggacag

SEQ ID NO: 2164 - DNA, 24 bp, Artificial Sequence
  Synthetic probe
aagtttgccccagactccaacagc

SEQ ID NO: 2165 - DNA, 24 bp, Artificial Sequence
  Synthetic probe
tgctccagagcatattgcaggaca

SEQ ID NO: 2166 - DNA, 29 bp, Artificial Sequence
  Synthetic probe
tctcagatcaatcgtgcatccttagtgaa

SEQ ID NO: 2167 - DNA, 24 bp, Artificial Sequence
  Synthetic probe
tcttatgcactcgcctcagcttgg

SEQ ID NO: 2168 - DNA, 24 bp, Artificial Sequence
  Synthetic probe
actcatcaatgggcagagtgcacc

SEQ ID NO: 2169 - DNA, 24 bp, Artificial Sequence
  Synthetic probe
tcctcagagacatcacgaagggcc

SEQ ID NO: 2170 - DNA, 23 bp, Artificial Sequence
  Synthetic probe
aattaacagccacccctcaggcg

SEQ ID NO: 2171 - DNA, 24 bp, Artificial Sequence
  Synthetic probe
aattttcccatgtgcaccattgca

SEQ ID NO: 2172 - DNA, 25 bp, Artificial Sequence
  Synthetic probe
tctgccttccctgaatcagacaacc

SEQ ID NO: 2173 - DNA, 24 bp, Artificial Sequence
  Synthetic probe
aggtgcttggagaccatccctcaa

SEQ ID NO: 2174 - DNA, 26 bp, Artificial Sequence
  Synthetic probe
caagctcccaggtgtctctcttctga

SEQ ID NO: 2175 - DNA, 24 bp, Artificial Sequence
  Synthetic probe
ccattcctggagctcacaactgct

SEQ ID NO: 2176 - DNA, 28 bp, Artificial Sequence
  Synthetic probe
aagccaggcgtctacacgagagtctcac

SEQ ID NO: 2177 - DNA, 24 bp, Artificial Sequence
  Synthetic probe
tcccaggaccctgaggttgcttta

SEQ ID NO: 2178 - DNA, 26 bp, Artificial Sequence
  Synthetic probe
caggcacacacaggtgggacacaaat

SEQ ID NO: 2179 - DNA, 24 bp, Artificial Sequence
  Synthetic probe
cccactgtggaagacaaagaggcc

SEQ ID NO: 2180 - DNA, 25 bp, Artificial Sequence
  Synthetic probe
caagtctggatctgggaccctttcc

SEQ ID NO: 2181 - DNA, 25 bp, Artificial Sequence
  Synthetic probe
ttgccttgctgctctacctccacca

SEQ ID NO: 2182 - DNA, 21 bp, Artificial Sequence
  Synthetic probe
ctgggcagcaccaagtccgga

SEQ ID NO: 2183 - DNA, 24 bp, Artificial Sequence
  Synthetic probe
atgcctcagtcttcccaaagcagg

SEQ ID NO: 2184 - DNA, 22 bp, Artificial Sequence
  Synthetic probe
atttcacgcatctggcgttcca

SEQ ID NO: 2185 - DNA, 24 bp, Artificial Sequence
  Synthetic probe
cgagaagttggctccctggtcaac

SEQ ID NO: 2186 - DNA, 24 bp, Artificial Sequence
  Synthetic probe
tggacactgtggaccctccctacc

SEQ ID NO: 2187 - DNA, 24 bp, Artificial Sequence
  Synthetic probe
ctccatgtcactgtgcagctcgac

SEQ ID NO: 2188 - DNA, 24 bp, Artificial Sequence
  Synthetic probe
tacaaaagcctccatttcggcacc

SEQ ID NO: 2189 - DNA, 20 bp, Artificial Sequence
  Synthetic probe
cgggctgcatcagcacacgc

SEQ ID NO: 2190 - DNA, 24 bp, Artificial Sequence
  Synthetic probe
cagtgagaaacgccccttcatgtg

SEQ ID NO: 2191 - DNA, 27 bp, Artificial Sequence
  Synthetic probe
ctgctgtttaccttggcgaggcctttc

SEQ ID NO: 2192 - DNA, 24 bp, Artificial Sequence
  Synthetic probe
tgaagccaaccttgtatctggcca

SEQ ID NO: 2193 - DNA, 27 bp, Artificial Sequence
  Synthetic probe
tccccaaattgcagatttatcaacggc

SEQ ID NO: 2194 - DNA, 22 bp, Artificial Sequence
  Synthetic probe
cctgctggcccattgcctagaa

SEQ ID NO: 2195 - DNA, 23 bp, Artificial Sequence
  Synthetic probe
ttgctgcctccgcacccttttct

SEQ ID NO: 2196 - DNA, 24 bp, Artificial Sequence
  Synthetic probe
atctcagttcggaccaggccagtc

SEQ ID NO: 2197 - DNA, 78 bp, Artificial Sequence
  Synthetic amplicon
cgttccgatcctctatactgcatcccaggcatgcctacagcaccctgatgtcgcagcctataaggccaacagggacct

SEQ ID NO: 2198 - DNA, 66 bp, Artificial Sequence
  Synthetic amplicon
ctctcccgccttcctagctgtcccagtggagaaggaacaagcgcctcactgcatctgtgcaaacgg

SEQ ID NO: 2199 - DNA, 66 bp, Artificial Sequence
  Synthetic amplicon
gtgtggcaggtggacactaaggaggaggtctggtcctttgaagcgggagacctggagtggatggag

SEQ ID NO: 2200 - DNA, 77 bp, Artificial Sequence
  Synthetic amplicon
aaacaccactggagcattgactaccaggctcgccaatgatgctgctcaagttaaaggggctataggttccaggcttg

SEQ ID NO: 2201 - DNA, 68 bp, Artificial Sequence
  Synthetic amplicon
tggcggagaactagccatcagcctcctgaagcctgccatcattgttaatttgaggactgggctgtctt

SEQ ID NO: 2202 - DNA, 67 bp, Artificial Sequence
  Synthetic amplicon
ccgctgtacgaggatttcactgccctcagcaatgaagcctacaagcaggacggcttcacagacacgg

SEQ ID NO: 2203 - DNA, 66 bp, Artificial Sequence
  Synthetic amplicon
tacaatgagaggctctgggcttgggaaagctggagatctgaggtcggcaagcagctgaggccatta

SEQ ID NO: 2204 - DNA, 73 bp, Artificial Sequence
  Synthetic amplicon
gaagtgccaggaggcgattaatgctacttgcaaaggcgtgtcctactgcacaggtaatagcagtgagtgcccg

SEQ ID NO: 2205 - DNA, 67 bp, Artificial Sequence
  Synthetic amplicon
gtcactgtgtccagcccacccttcccagttcctgtctacacccggcaggcaccaaagcaggtcatca

SEQ ID NO: 2206 - DNA, 73 bp, Artificial Sequence
  Synthetic amplicon
ggacaggtgcaagctcatctgccaagccaaaggcattggctacttcttcgttttgcagcccaaggttgtagat

SEQ ID NO: 2207 - DNA, 66 bp, Artificial Sequence
  Synthetic amplicon
gagaatgtctgccgctgggcctacctccagcagaagccagacacgggccacgatgaataccacgat

SEQ ID NO: 2208 - DNA, 71 bp, Artificial Sequence
  Synthetic amplicon
tttgacaagtgcatggtgtgcggaggggacggttctggttgcagcaagcagtcaggctccttcaggaaatt

SEQ ID NO: 2209 - DNA, 79 bp, Artificial Sequence
  Synthetic amplicon
cactgtggctcacgaaatcggacatttacttggcctctcccatgacgattccaaattctgtgaagagacctttggttcc

SEQ ID NO: 2210 - DNA, 72 bp, Artificial Sequence
  Synthetic amplicon
gcgagttcaaagtgttcgaggccaaggtgattgatggcaccctgtgtgggccagaaacactggccatctgtg

SEQ ID NO: 2211 - DNA, 66 bp, Artificial Sequence
  Synthetic amplicon
gcacaggttacacaacccaacagaatgtccctataacgggagccggcgcgatgactgccaatgtcg

SEQ ID NO: 2212 - DNA, 74 bp, Artificial Sequence
  Synthetic amplicon
gtctacccagcagctccgcaaggagggatggctgccttaaacatgagtcttggtatggtgactcctgtgaacga

SEQ ID NO: 2213 - DNA, 67 bp, Artificial Sequence
  Synthetic amplicon
aagaccatcacctccgtggccatgaccagtgctctgcccatcatccagaagctagagccgcaaattg

SEQ ID NO: 2214 - DNA, 84 bp, Artificial Sequence
  Synthetic amplicon
aagccaacaaaccttccttcttaaccattctactgtgtcacctttgccattgaggaaaaatattcctgtgacttcttgcatttt

SEQ ID NO: 2215 - DNA, 68 bp, Artificial Sequence
  Synthetic amplicon
tgttggggagtaaacacttggacctcttgtatcccaccatcttgggccatgaaggggctggaatcgtt

SEQ ID NO: 2216 - DNA, 75 bp, Artificial Sequence
  Synthetic amplicon
taagccacaagcacacggggctccagcccccccgagtggaagtgctccccactttctttaggatttaggcgccca

SEQ ID NO: 2217 - DNA, 70 bp, Artificial Sequence
  Synthetic amplicon
agccaacatgtgactaattggaagaagagcaaagggtggtgacgtgttgatgaggcagatggagatcaga

SEQ ID NO: 2218 - DNA, 73 bp, Artificial Sequence
  Synthetic amplicon
gatccagcctcactatgcctctgacctggacaaggtggagggtctcactttccagcaaaactccctcaactgg

SEQ ID NO: 2219 - DNA, 67 bp, Artificial Sequence
  Synthetic amplicon
agcattgatcgatacctggctattgttcacccaatgaagtcccgccttcgacgcacaatgcttgtag

SEQ ID NO: 2220 - DNA, 69 bp, Artificial Sequence
  Synthetic amplicon
gcggcatagagaccgacttaatacagagttggaccgtttggctagcctgctgcctttcccacaagatgt

SEQ ID NO: 2221 - DNA, 71 bp, Artificial Sequence
  Synthetic amplicon
gacgttcagctaccctgactttctcaggatgatgctgggcaagagatctgccatcctaaaaatgatcctga

SEQ ID NO: 2222 - DNA, 71 bp, Artificial Sequence
  Synthetic amplicon
cgcttctatggcgctgagattgtgtcagccctggactacctgcactcggagaagaacgtggtgtaccggga

SEQ ID NO: 2223 - DNA, 71 bp, Artificial Sequence
  Synthetic amplicon
tcctgccacccttcaaacctcaggtcacgtccgaggtcgacacaaggtacttcgatgatgaatttaccgcc

SEQ ID NO: 2224 - DNA, 75 bp, Artificial Sequence
  Synthetic amplicon
ttgtctctgccttggactatctacattccggaaagattgtgtaccgtgatctcaagttggagaatctaatgctgg

SEQ ID NO: 2225 - DNA, 68 bp, Artificial Sequence
  Synthetic amplicon
ggacagggtaagaccgtgatccaagcggagattgacgctgcagcggaactcatcgacttcttccggtt

SEQ ID NO: 2226 - DNA, 66 bp, Artificial Sequence
  Synthetic amplicon
ggctctttcaacagcagtccttgtgggagaagccaagaagtggctgccagagctggtggagcatgc

SEQ ID NO: 2227 - DNA, 69 bp, Artificial Sequence
  Synthetic amplicon
gcctgtacgtgccagctccccgactgccagagcctcaactgtctctgcttcgagatcaagctccgatga

SEQ ID NO: 2228 - DNA, 80 bp, Artificial Sequence
  Synthetic amplicon
ccctctaccagaaggacagccagggaaagctgttcagaaacatcctcaaggaaaaggggatcgtggtgggaatcaagtta

SEQ ID NO: 2229 - DNA, 67 bp, Artificial Sequence
  Synthetic amplicon
agttcctcaatggtgccaaccccatgctgttgagacgctcgacctctctgccctccaggctagtgct

SEQ ID NO: 2230 - DNA, 66 bp, Artificial Sequence
  Synthetic amplicon
gagctgcaggacttcgtgaacgatgtctacgtgtacggcatgcggggccgcaagtcctcaggcttc

SEQ ID NO: 2231 - DNA, 71 bp, Artificial Sequence
  Synthetic amplicon
ggacagtcagttttagggttgcctgtatccagtaactcggggcctgtttccccgtgggtctctgggctgtc

SEQ ID NO: 2232 - DNA, 71 bp, Artificial Sequence
  Synthetic amplicon
tctacttggggtgacagtgctcacgtggctcgactatagaaaactccactgactgtcgggctttaaaaagg

SEQ ID NO: 2233 - DNA, 69 bp, Artificial Sequence
  Synthetic amplicon
ccgtgaaagctgctctgtaaaagctgacacagccctcccaagtgagcaggactgttcttcccactgcaa

SEQ ID NO: 2234 - DNA, 66 bp, Artificial Sequence
  Synthetic amplicon
gccatctgcgtcaactccaaggagcctgaggtgcttctggagaaccgagtgcataagcaggagcta

SEQ ID NO: 2235 - DNA, 78 bp, Artificial Sequence
  Synthetic amplicon
gttgcgattactggcaatgtccccaatgcaatcccggaaaacaaagatttggtgttttctacttgggatcacaaagca

SEQ ID NO: 2236 - DNA, 66 bp, Artificial Sequence
  Synthetic amplicon
atgacctcagatggaggctggacagtaattcagaggcgccacgatggctcagtggacttcaaccgg

SEQ ID NO: 2237 - DNA, 67 bp, Artificial Sequence
  Synthetic amplicon
ctgcacagactccaacctcaatggagtgtactaccgcctgggtgagcacaataagcacctggatggc

SEQ ID NO: 2238 - DNA, 67 bp, Artificial Sequence
  Synthetic amplicon
ctccaggtgtacctccaaccctagccttctcccacagctgcctacaacagagtctcccagccttctc

SEQ ID NO: 2239 - DNA, 67 bp, Artificial Sequence
  Synthetic amplicon
gcccctatcctaccttcaatccatcctcggatgtcgctgccttgcataaggccataatggttaaagg

SEQ ID NO: 2240 - DNA, 71 bp, Artificial Sequence
  Synthetic amplicon
caagacactaagggcgactaccagaaagcgctgctgtacctgtgtggtggagatgactgaagcccgacacg

SEQ ID NO: 2241 - DNA, 67 bp, Artificial Sequence
  Synthetic amplicon
tgggagggatgaaggaaattatctggacgatgctctcgtgagacaggatgcccaggacctgtatgag

SEQ ID NO: 2242 - DNA, 67 bp, Artificial Sequence
  Synthetic amplicon
gctcaagcctggaagatgacgtggtgggggacacttcagggtactaccagcggatgttggtggttct

SEQ ID NO: 2243 - DNA, 81 bp, Artificial Sequence
  Synthetic amplicon
gactgcaaagatggaaacgaccttctatgacgatgccctcaacgcctcgttcctcccgtccgagagcggaccttatggcta

SEQ ID NO: 2244 - DNA, 67 bp, Artificial Sequence
  Synthetic amplicon
acaacgaccgcaccatctccttcatcccgcctgatggtgactttgagctcatgtcataccgcctcag

SEQ ID NO: 2245 - DNA, 66 bp, Artificial Sequence
  Synthetic amplicon
cacaaggaagaagctggtgaatgcaattcagcagaagctctccaaattgaaaggtgaaccaggatg

SEQ ID NO: 2246 - DNA, 69 bp, Artificial Sequence
  Synthetic amplicon
ggacagcaggaatgtgtttctccatacaggtcacggggagccaatggttcagaaacaaatcgagtgggt

SEQ ID NO: 2247 - DNA, 70 bp, Artificial Sequence
  Synthetic amplicon
ccagcctgataaaggtcctgcgggcaggacaggacctcccaaccaagccctccagcaaggattcagagtg

SEQ ID NO: 2248 - DNA, 75 bp, Artificial Sequence
  Synthetic amplicon
gcctcaagagctggttcgagcccctggtggaagacatgcagcgccagtgggccgggctggtggagaaggtgcagg

SEQ ID NO: 2249 - DNA, 73 bp, Artificial Sequence
  Synthetic amplicon
cggaccaagaactgtgaccacagggcagggcagccaccaggagagatatgcctggcaggggccaggacaaaat

SEQ ID NO: 2250 - DNA, 66 bp, Artificial Sequence
  Synthetic amplicon
gagcagctggagtctcgggttcagctctgcaccaagtccagtcgtggccacgacctcaagatctct

SEQ ID NO: 2251 - DNA, 66 bp, Artificial Sequence
  Synthetic amplicon
gcttgctgtatgacccctggccacagccttccctctgcattgacctggaggggagaggtcagcctt

SEQ ID NO: 2252 - DNA, 82 bp, Artificial Sequence
  Synthetic amplicon
tgtgagtgaaatgccttctagtagtgaaccgtcctcgggagccgactatgactactcagaagagtatgataacgaaccacaa

SEQ ID NO: 2253 - DNA, 64 bp, Artificial Sequence
  Synthetic amplicon
cagtagagatccccgcaactcgcttgtccttgggtcaccctgcattccatagccatgtgcttgt

SEQ ID NO: 2254 - DNA, 67 bp, Artificial Sequence
  Synthetic amplicon
gcatgggctactgcatcctttttgtgcacggactgagcaagctctgcacttggctgaatcgatgtgg

SEQ ID NO: 2255 - DNA, 71 bp, Artificial Sequence
  Synthetic amplicon
actctgcttcccaagggcaaccgttgctgttcacacgctcagcctgtctgggggagcgggcctctagcttc

SEQ ID NO: 2256 - DNA, 73 bp, Artificial Sequence
  Synthetic amplicon
ggtcctccgtcggttctctcattagtccacggtctggtcttcagctacccgccttcgtctccgagtttgcgac

SEQ ID NO: 2257 - DNA, 66 bp, Artificial Sequence
  Synthetic amplicon
tggtccctagaacaagaggcttaaaaccgggctttcacccaacctgctccctctgatcctccatca

SEQ ID NO: 2258 - DNA, 69 bp, Artificial Sequence
  Synthetic amplicon
tgcaggaacgcctcatcaagaagctgggcgagcacgcttaccctttcacctttgagatccctccaaacc

SEQ ID NO: 2259 - DNA, 85 bp, Artificial Sequence
  Synthetic amplicon
cccccagataaaggtcattgctccctggaggatgcctgaattctacaaccggttcaagggccgcaatgacctgatggagtacgca

SEQ ID NO: 2260 - DNA, 67 bp, Artificial Sequence
  Synthetic amplicon
agaacgcctatttggagctggggggcctcggagaacgagtcctaggtttctgccacctctttctgcc

SEQ ID NO: 2261 - DNA, 66 bp, Artificial Sequence
  Synthetic amplicon
ccgctttcgctacagcatggtggcctactggagacaggctggactcagctacatccgatactccca

SEQ ID NO: 2262 - DNA, 67 bp, Artificial Sequence
  Synthetic amplicon
aaccatggggaacgtctgcctcttcctgaacttggccaatgaccccacgatcgagcggatcatcacc

SEQ ID NO: 2263 - DNA, 66 bp, Artificial Sequence
  Synthetic amplicon
ttgcagccctgtcttcctacctatcccacctccatcccagacaggtccctccccttctctgtgcag

SEQ ID NO: 2264 - DNA, 74 bp, Artificial Sequence
  Synthetic amplicon
ccgaggccctgacttcttcacccgagtggcgctcttccgagactggatcgatggtgttctcaacaacccgggac

SEQ ID NO: 2265 - DNA, 80 bp, Artificial Sequence
  Synthetic amplicon
ggctcttgtgcgtactgtccttcgggctggtgacagggaagacatcactgagcctgccatctgtgctcttcgtcatctga

SEQ ID NO: 2266 - DNA, 67 bp, Artificial Sequence
  Synthetic amplicon
gggatcgagacatgtaagcagcatcatggaggtttgaagatgccgcatttggattggatgaattcca

SEQ ID NO: 2267 - DNA, 73 bp, Artificial Sequence
  Synthetic amplicon
gggtcaggggcctcgagatcgggcttgggcccagagcatgttccagatcccagagtttgagccgagtgagcag

SEQ ID NO: 2268 - DNA, 81 bp, Artificial Sequence
  Synthetic amplicon
cgttgtcagcacttggaatacaagatggttgccgggtcatgttaattgggaaaaagaacagtccacaggaagaggttgaac

SEQ ID NO: 2269 - DNA, 69 bp, Artificial Sequence
  Synthetic amplicon
ctaggggcaaaaagcatgactgctttttcctgtctggcatggaatcacgcagtcaccttgggcatttag

SEQ ID NO: 2270 - DNA, 66 bp, Artificial Sequence
  Synthetic amplicon
ccattcccaccattctacctgaggccaggacgtctggggtgtggggattggtgggtctatgttccc

SEQ ID NO: 2271 - DNA, 70 bp, Artificial Sequence
  Synthetic amplicon
ccgccgtggacacagactccccccgagaggtctttttccgagtggcagctgacatgttttctgacggcaa

SEQ ID NO: 2272 - DNA, 83 bp, Artificial Sequence
  Synthetic amplicon
cctggagggtcctgtacaatctcatcatgggactcctgcccttacccaggggccacagagcccccgagatggagcccaattag

SEQ ID NO: 2273 - DNA, 73 bp, Artificial Sequence
  Synthetic amplicon
cagatggacctagtacccactgagatttccacgccgaaggacagcgatgggaaaaatgcccttaaatcatagg

SEQ ID NO: 2274 - DNA, 79 bp, Artificial Sequence
  Synthetic amplicon
ccagcctccatgtatcatcatgtgtcataactcagtcaagctcagtgagcattctcagcacattgcctcaacagcttca

SEQ ID NO: 2275 - DNA, 73 bp, Artificial Sequence
  Synthetic amplicon
aacccacccctgtcttggagctccgggtagctctcaaactcgaggctgcgcaccccctttcccgtcagctgag

SEQ ID NO: 2276 - DNA, 70 bp, Artificial Sequence
  Synthetic amplicon
cttttgtggaactctatgggaacaatgcagcagccgagagccgaaagggccaggaacgcttcaaccgctg

SEQ ID NO: 2277 - DNA, 74 bp, Artificial Sequence
  Synthetic amplicon
tgtactggcgaagaatatttggtaaagcagggcatcgatctctcaccctggggcttgtggaagaatcacgtggc

SEQ ID NO: 2278 - DNA, 77 bp, Artificial Sequence
  Synthetic amplicon
ccaggaagaatgcttaagatgtgagtggatggatctcaatgacctggcgaagactgaaaatacaactcccatcacca

SEQ ID NO: 2279 - DNA, 66 bp, Artificial Sequence
  Synthetic amplicon
gagctccgcaaggatgacttcaagggtctccagcacctctacgccctcgtcctggtgaacaacaag

SEQ ID NO: 2280 - DNA, 68 bp, Artificial Sequence
  Synthetic amplicon
aggaagatccctcgcagccaggaaaggaagctccctgaatccttgcgtcccgaaggacggaggttcaa

SEQ ID NO: 2281 - DNA, 70 bp, Artificial Sequence
  Synthetic amplicon
attcctatggctctgcaattgtcaccggttaactgtggcctgtgcccaggaagagccattcactcctgcc

SEQ ID NO: 2282 - DNA, 76 bp, Artificial Sequence
  Synthetic amplicon
cctgcaaaagggaacaagagcccttcgcctccagatggctcccctgccgccacccccgagatcagagtcaaccacg

SEQ ID NO: 2283 - DNA, 67 bp, Artificial Sequence
  Synthetic amplicon
gaccaagcaggaagctcagactggttgagttcaggtagctgcccctggctctgaccgaaacagcgct

SEQ ID NO: 2284 - DNA, 68 bp, Artificial Sequence
  Synthetic amplicon
ctggacggagtagctccaagagctctcactgtgacagcccacctcgctcgcagacaccacaagatacc

SEQ ID NO: 2285 - DNA, 65 bp, Artificial Sequence
  Synthetic amplicon
tcagggggctagaaatctgttgctatgggcccttcaccaacatgcccacagatcaactggaatgg

SEQ ID NO: 2286 - DNA, 63 bp, Artificial Sequence
  Synthetic amplicon
gttgggacacagttggtctgcagtcggcccaggacggtctactcagcacaactgactgcttca

SEQ ID NO: 2287 - DNA, 68 bp, Artificial Sequence
  Synthetic amplicon
ccgaggttaatccagcacgtatggggccaagtgtaggctcccagcaggaactgagagcgccatgtctt

SEQ ID NO: 2288 - DNA, 73 bp, Artificial Sequence
  Synthetic amplicon
ctgaagcagatggttcatcatttcctgggctgttaaacaaagcgaggttaaggttagactcttgggaatcagc

SEQ ID NO: 2289 - DNA, 75 bp, Artificial Sequence
  Synthetic amplicon
gaggcaactgcttatggcttaattaagtcagatgcggccatgactgtcgctgtaaagatgctcaagccgagtgcc

SEQ ID NO: 2290 - DNA, 84 bp, Artificial Sequence
  Synthetic amplicon
tagaatctgctgccagaggggacaaagacgtgcactcaaccttctaccaggccactctcaggctcaccttaaaatcagcccttg

SEQ ID NO: 2291 - DNA, 66 bp, Artificial Sequence
  Synthetic amplicon
cggtcatcaccaaccaggaagaaccgtaccagaaccactccggccgattcgtctgcactgtacccg

SEQ ID NO: 2292 - DNA, 70 bp, Artificial Sequence
  Synthetic amplicon
ccagtggcctcacaggacaccagcttcccaggaggcgtctgacacagtatgatgatgaagatcccatggg

SEQ ID NO: 2293 - DNA, 65 bp, Artificial Sequence
  Synthetic amplicon
tcagctgtgagctgcggataccgcccggcaatgggacctgctcttaacctcaaacctaggaccgt

SEQ ID NO: 2294 - DNA, 67 bp, Artificial Sequence
  Synthetic amplicon
cgtgaaggagtgcagaaagaggacatcccacctgcagacctcagtgaccaagtcccggacaccgagt

SEQ ID NO: 2295 - DNA, 66 bp, Artificial Sequence
  Synthetic amplicon
aagccgcatcccagacttgctgaatcggaatctctgggggttgggacccagcaagggcacttaaca

SEQ ID NO: 2296 - DNA, 69 bp, Artificial Sequence
  Synthetic amplicon
atgtctgagtgtgaggcgggcgctctgagatgcagagggcagagcatctctgtcaccagcataaggcct

SEQ ID NO: 2297 - DNA, 66 bp, Artificial Sequence
  Synthetic amplicon
ctctctgaaggtgtcctggccagccctggagaagcactggtgtctgcagcacccctcagttcctgt

SEQ ID NO: 2298 - DNA, 69 bp, Artificial Sequence
  Synthetic amplicon
caacgtggagtttgatgactctcaggacaaagcagtgctcaagggaggacccctggatggcacttacag

SEQ ID NO: 2299 - DNA, 72 bp, Artificial Sequence
  Synthetic amplicon
atcctagccctggtttttggcctcctttttgctgtcaccagcgtcgcgttccttgtgcagatgagaaggcag

SEQ ID NO: 2300 - DNA, 68 bp, Artificial Sequence
  Synthetic amplicon
caaacattagctgggcctgttccatggcataacactaaggcgcagactcctaaggcacccactggctg

SEQ ID NO: 2301 - DNA, 78 bp, Artificial Sequence
  Synthetic amplicon
cactaaggtttgagacagttccagaaagaacccaagctcaagacgcaggacgagctcagttgtagagggctaattcgc

SEQ ID NO: 2302 - DNA, 77 bp, Artificial Sequence
  Synthetic amplicon
agaaagcccacatagagaaggattttatcgctttctgctcttccacaccagataatgtttcttggagacatcccaca

SEQ ID NO: 2303 - DNA, 66 bp, Artificial Sequence
  Synthetic amplicon
acctttctcttggccggatgtcctcagggctggcagatgcagtagactgcagtggacagtccccac

SEQ ID NO: 2304 - DNA, 67 bp, Artificial Sequence
  Synthetic amplicon
cctcacactggtgaacaggaaagtttctcagcgccgagtggacttttgcaaagacccaagtgcaatt

SEQ ID NO: 2305 - DNA, 66 bp, Artificial Sequence
  Synthetic amplicon
tgagcctgagcagagacatgactcagcctgttccatgaaggcagagccatggaccacgcaggaagg

SEQ ID NO: 2306 - DNA, 78 bp, Artificial Sequence
  Synthetic amplicon
atccattcgatctcaccaaggtttggcctcacaaggactaccctctcatcccagttggtaaactggtcttaaaccgga

SEQ ID NO: 2307 - DNA, 74 bp, Artificial Sequence
  Synthetic amplicon
gtggctcaacattgtgttcccatttcagctgatcagtgggcctccaaggaggggctgtaaaatggaggccattg

SEQ ID NO: 2308 - DNA, 66 bp, Artificial Sequence
  Synthetic amplicon
cttccctgggacgacttgccagctctgaggcatgacagtacgggcccccagaagggtgaccaggag

SEQ ID NO: 2309 - DNA, 68 bp, Artificial Sequence
  Synthetic amplicon
gctcctgtgcacaagttggtaccaacaaagagctctgctgcctcgtctatacctcctggcagattcca

SEQ ID NO: 2310 - DNA, 78 bp, Artificial Sequence
  Synthetic amplicon
gaacgcatcatccagagactgcagaggacctcagccaagatgaagcgccgcagcagttaacctatgaccgtgcagagg

SEQ ID NO: 2311 - DNA, 69 bp, Artificial Sequence
  Synthetic amplicon
ccatgtgctgtaccaagagtttgctcctggctgctttgatgtcagtgctgctactccacctctgcggcg

SEQ ID NO: 2312 - DNA, 70 bp, Artificial Sequence
  Synthetic amplicon
gggtccaggagtacgtgtatgacctggaactgaactgagctgctcagagacaggaagtcttcagggaagg

SEQ ID NO: 2313 - DNA, 65 bp, Artificial Sequence
  Synthetic amplicon
aggttctgagctctggctttgccttggctttgccagggctctgtgaccaggaaggaagtcagcat

SEQ ID NO: 2314 - DNA, 84 bp, Artificial Sequence
  Synthetic amplicon
ttcaggttgttgcaggagaccatgtacatgactgtctccattattgatcggttcatgcagaataattgtgtgcccaagaagatg

SEQ ID NO: 2315 - DNA, 69 bp, Artificial Sequence
  Synthetic amplicon
gcatgttcgtggcctctaagatgaaggagaccatccccctgacggccgagaagctgtgcatctacaccg

SEQ ID NO: 2316 - DNA, 71 bp, Artificial Sequence
  Synthetic amplicon
aaagaagatgatgaccgggtttacccaaactcaacgtgcaagcctcggattattgcaccatccagaggctc

SEQ ID NO: 2317 - DNA, 85 bp, Artificial Sequence
  Synthetic amplicon
ggtcaccaagaaacatcagtatgaaattaggaattgttggccacctgtattatctggggggatcagtccttgcattatcattgaa

SEQ ID NO: 2318 - DNA, 82 bp, Artificial Sequence
  Synthetic amplicon
atgctgtggctccttcctaactggggctttcttgacatgtaggttgcttggtaataacctttttgtatatcacaatttgggt

SEQ ID NO: 2319 - DNA, 66 bp, Artificial Sequence
  Synthetic amplicon
tccaagacccaatgggaattcactcaccacacctgcagccttcactttcctcacgaaagcctacga

SEQ ID NO: 2320 - DNA, 67 bp, Artificial Sequence
  Synthetic amplicon
ctcgggaatcctgaaaaccctgcttcggtgtcgaaacgagaagaagaggcatagggcagtgagagtc

SEQ ID NO: 2321 - DNA, 82 bp, Artificial Sequence
  Synthetic amplicon
agaccctggtggagctagaagtccttcaggactgcacctttgaaagatacttggactatgccatccaggccacagaaactct

SEQ ID NO: 2322 - DNA, 67 bp, Artificial Sequence
  Synthetic amplicon
cagactgaatgggggtggggggggcgccttaggtacttattccagatgccttctccagacaaaccag

SEQ ID NO: 2323 - DNA, 64 bp, Artificial Sequence
  Synthetic amplicon
ggatgacatgcactcagctcttggctccactgggatgggaggagaggacaagggaaatgtcagg

SEQ ID NO: 2324 - DNA, 75 bp, Artificial Sequence
  Synthetic amplicon
gcaggtgtcagcaagtatgatcagcaatgaggcggtggtcaatatcctgtcgagctcatcaccacagcggaaaaa

SEQ ID NO: 2325 - DNA, 66 bp, Artificial Sequence
  Synthetic amplicon
gtgtgctagcgtactcccgcctcaaggaactgacgctcgaggacctaaagataaccggcaccatgc

SEQ ID NO: 2326 - DNA, 81 bp, Artificial Sequence
  Synthetic amplicon
cgtcaggacccaccatgtctgccccatcacgcggccgagacatggcttggccacagctcttgaggatgtcaccaattaacc

SEQ ID NO: 2327 - DNA, 78 bp, Artificial Sequence
  Synthetic amplicon
ggagtggaaggaactggaaacattattccgtatacgcaccattcggtcatttgagggaattcgtagatacgcccatga

SEQ ID NO: 2328 - DNA, 77 bp, Artificial Sequence
  Synthetic amplicon
tccaactaatgccaccaccaaggcggctggtggtgccctgcagtcaacagccagtctcttcgtggtctcactctctc

SEQ ID NO: 2329 - DNA, 69 bp, Artificial Sequence
  Synthetic amplicon
gctgcatgatcagctatggtggtgccgactacaagcgaattactgtgaaagtcaatgccccatacaaca

SEQ ID NO: 2330 - DNA, 75 bp, Artificial Sequence
  Synthetic amplicon
tgtatttcaagacctctgtgcacttatttatgaacctgccctgctcccacagaacacagcaattcctcaggctaa

SEQ ID NO: 2331 - DNA, 67 bp, Artificial Sequence
  Synthetic amplicon
ccactgcacacacctcagaggctgttcttggggccctacaccttgaggaggggcaggtaaactcctg

SEQ ID NO: 2332 - DNA, 67 bp, Artificial Sequence
  Synthetic amplicon
gtaacccaggacgctgaggacaacacagtctctttcctgcagcccaatggtgccatcttcgaacctt

SEQ ID NO: 2333 - DNA, 65 bp, Artificial Sequence
  Synthetic amplicon
agatgaagtggaaggcgcttttcaccgcggccatcctgcaggcacagttgccgattacagaggca

SEQ ID NO: 2334 - DNA, 67 bp, Artificial Sequence
  Synthetic amplicon
gtgctggagtcgggactaacccaggtcccttgtcccaagttccactgctgcctcttgaatgcaggga

SEQ ID NO: 2335 - DNA, 67 bp, Artificial Sequence
  Synthetic amplicon
ggcaccactgcttatgaaggaaactggaacccagaagcacaccctcccctcattcaccatgagcatc

SEQ ID NO: 2336 - DNA, 78 bp, Artificial Sequence
  Synthetic amplicon
gacgaagacagtccctggatcaccgacagcacagacagaatccctgctaccagagaccaagacacattccaccccagt

SEQ ID NO: 2337 - DNA, 78 bp, Artificial Sequence
  Synthetic amplicon
ctcataccagccatccaatgcaaggaaggacaacaccaagcccagaggacagttcctggactgatttcttcaacccaa

SEQ ID NO: 2338 - DNA, 72 bp, Artificial Sequence
  Synthetic amplicon
cgacagcatccaccgttaccactcagacaatagcaccaaggcagcgtgggactccatccagtcatttctgca

SEQ ID NO: 2339 - DNA, 74 bp, Artificial Sequence
  Synthetic amplicon
tggttcccagccctgtgtccacctccaagcccagattcagattcgagtcatgtacacaacccagggtggaggag

SEQ ID NO: 2340 - DNA, 84 bp, Artificial Sequence
  Synthetic amplicon
gtgcaggctcaggtgaagtgctgcggctgggtcagcttctacaactggacagacaacgctgagctcatgaatcgccctgaggtc

SEQ ID NO: 2341 - DNA, 68 bp, Artificial Sequence
  Synthetic amplicon
agggtgaggtgcttgagtctccaacggcaagggaacaagtacttcttgatacctgggatactgtgccc

SEQ ID NO: 2342 - DNA, 77 bp, Artificial Sequence
  Synthetic amplicon
gttcctccggtagcttttcagatgctgaccttgcggatggcgtttcaggtggagaaggaaaaggaggcagtgatggt

SEQ ID NO: 2343 - DNA, 71 bp, Artificial Sequence
  Synthetic amplicon
tcttgctggctacgcctcttctgtccctgttagacgtcctccgtccatatcagaactgtgccacaatgcag

SEQ ID NO: 2344 - DNA, 85 bp, Artificial Sequence
  Synthetic amplicon
aaacgagcagtttgccatcagacgcttccagtctatgccggtgaggctgctgggccacagccccgtgcttcggaacatcaccaac

SEQ ID NO: 2345 - DNA, 81 bp, Artificial Sequence
  Synthetic amplicon
tgagtgtcccccggtatcttccccgccctgccaatcccgatgaaattggaaattttattgatgaaaatctgaaagcggctg

SEQ ID NO: 2346 - DNA, 67 bp, Artificial Sequence
  Synthetic amplicon
gctacttctccactgtcccgttcagtctgaatgctgccacaaccagccaggcaggtccacagagagg

SEQ ID NO: 2347 - DNA, 67 bp, Artificial Sequence
  Synthetic amplicon
gactgtctgaatggcccaggcagctctagctgggagcttggcctctggctccatctgagtcccctgg

SEQ ID NO: 2348 - DNA, 66 bp, Artificial Sequence
  Synthetic amplicon
tgaccgataaggatcaaccccatacaccagcctggaacgcagtgtacagaatcagtggcggagatc

SEQ ID NO: 2349 - DNA, 67 bp, Artificial Sequence
  Synthetic amplicon
acaggagacgtgttcgccattgagaggctggaccgggagaatatctcagagtaccacctcactgctg

SEQ ID NO: 2350 - DNA, 66 bp, Artificial Sequence
  Synthetic amplicon
acacaggcgacatacaggccaccaagaggctggacagggaagaaaaacccgtttacatccttcgag

SEQ ID NO: 2351 - DNA, 66 bp, Artificial Sequence
  Synthetic amplicon
ccttcccatcagcacagttcgtgaggtggctttactgaggcgactggaggcttttgagcatcccaa

SEQ ID NO: 2352 - DNA, 67 bp, Artificial Sequence
  Synthetic amplicon
agtgccctgtctcacccatacttccaggacctggaaaggtgcaaagaaaacctggattcccacctgc

SEQ ID NO: 2353 - DNA, 79 bp, Artificial Sequence
  Synthetic amplicon
agcactcacgccctaagcgcacattcatgtgggcatttcttgcgagcctcgcagcctccggaagctgtcgacttcatga

SEQ ID NO: 2354 - DNA, 71 bp, Artificial Sequence
  Synthetic amplicon
acttgcctgttcagagcactcattccttcccacccccagtcctgtcctatcactctaattcggatttgcca

SEQ ID NO: 2355 - DNA, 66 bp, Artificial Sequence
  Synthetic amplicon
ttggttttgctcggatacttgccaaaatgagactctccgtcggcagctgggggaagggtctgagac

SEQ ID NO: 2356 - DNA, 68 bp, Artificial Sequence
  Synthetic amplicon
ctcccgtcaacagcgttctttccaaacactggaccaggagtgcatccagatgaaggccagactcaccc

SEQ ID NO: 2357 - DNA, 66 bp, Artificial Sequence
  Synthetic amplicon
ggacttttgtccagtgacagctgagacaacaaggaccacgggaggaggtgtaggagagaagcgccg

SEQ ID NO: 2358 - DNA, 76 bp, Artificial Sequence
  Synthetic amplicon
ctgaaggagctccaagacctcgctctccaaggcgccaaggagagggcacatcagcagaagaaacacagcggttttg

SEQ ID NO: 2359 - DNA, 82 bp, Artificial Sequence
  Synthetic amplicon
gataaattggtacaagggatcagcttttcccagcccacatgtcctgatcatatgcttttgaatagtcagttacttggcaccc

SEQ ID NO: 2360 - DNA, 78 bp, Artificial Sequence
  Synthetic amplicon
atgtggaacccccacctacttggcgcctgaagttcttgtttctgttgggactgctgggtataaccgtgctgtggactg

SEQ ID NO: 2361 - DNA, 72 bp, Artificial Sequence
  Synthetic amplicon
tgcctgtggtgggaagctcagtaactgggaaccaaaggatgatgctatgtcagaacaccggaggcattttcc

SEQ ID NO: 2362 - DNA, 86 bp, Artificial Sequence
  Synthetic amplicon
ggatatttccgtggctcttattcaaactctccatcaaatcctgtaaactccagagcaaatcaagatttttctgccttgatgagaag

SEQ ID NO: 2363 - DNA, 67 bp, Artificial Sequence
  Synthetic amplicon
gtgaccctgaagctgtccccagagacttccctgcatgaggcacacaacctctttgagctgttgaacc

SEQ ID NO: 2364 - DNA, 66 bp, Artificial Sequence
  Synthetic amplicon
ggtctgtggatgaactgcgcaggtaacgcgttgggttctttccattgccgaccgcattttactatc

SEQ ID NO: 2365 - DNA, 74 bp, Artificial Sequence
  Synthetic amplicon
ggtctgccctagtcatcctgggaggtgcactgctctcctgttcctgtcctgggaatgagagcaaggctgggtac

SEQ ID NO: 2366 - DNA, 76 bp, Artificial Sequence
  Synthetic amplicon
ccccaggatacctaccactacctgcccttcagcctgccccaccggaggcctcacttcttctttcccaagtcccgca

SEQ ID NO: 2367 - DNA, 86 bp, Artificial Sequence
  Synthetic amplicon
gacatttccagtcctgcagtcaatgcctctctgccccaccctttgttcagtgtggctggtgccacgacaaatgtgtgcgatcggag

SEQ ID NO: 2368 - DNA, 84 bp, Artificial Sequence
  Synthetic amplicon
tccctccactcggaaggactatcctgctgccaagagggtcaagttggacagtgtcagagtcctgagacagatcagcaacaaccg

SEQ ID NO: 2369 - DNA, 67 bp, Artificial Sequence
  Synthetic amplicon
agctgccatcacgcctacatcgtgctctgcattgagaacagcttcatgactgcctccaagtagccac

SEQ ID NO: 2370 - DNA, 68 bp, Artificial Sequence
  Synthetic amplicon
gtggccatccagctgaccttcctgcgcctgatgtccaccgaggcctcccagaacatcacctaccactg

SEQ ID NO: 2371 - DNA, 80 bp, Artificial Sequence
  Synthetic amplicon
cagccaagaactggtataggagctccaaggacaagaaacacgtctggctaggagaaactatcaatgctggcagccagttt

SEQ ID NO: 2372 - DNA, 66 bp, Artificial Sequence
  Synthetic amplicon
acaaaggcctcccaggattggatggcatccctggtgtcaaaggagaagcaggtcttcctgggactc

SEQ ID NO: 2373 - DNA, 67 bp, Artificial Sequence
  Synthetic amplicon
caaccctggtgatgtctgctactatgccagccggaacgacaagtcctactggctctctaccactgcg

SEQ ID NO: 2374 - DNA, 72 bp, Artificial Sequence
  Synthetic amplicon
ggtcgaggaacccaaggtccgcctggtgctacaggatttcctggttctgcgggcagagttggacctccaggc

SEQ ID NO: 2375 - DNA, 66 bp, Artificial Sequence
  Synthetic amplicon
ggtgacaaaggacctcggggagacaatggggaccctggtgacaagggcagcaagggagagcctggt

SEQ ID NO: 2376 - DNA, 79 bp, Artificial Sequence
  Synthetic amplicon
tctgcagagttggaagcactctatggtgacatcgatgctgtggagctgtatcctgcccttctggtagaaaagcctcggc

SEQ ID NO: 2377 - DNA, 73 bp, Artificial Sequence
  Synthetic amplicon
cgtgagtacacagatgcctccttcacaaatcgaaaggagagaggccctgaagaagagcatcttggcatcctgg

SEQ ID NO: 2378 - DNA, 67 bp, Artificial Sequence
  Synthetic amplicon
ggcacatacggattcttgctgccggagcgttacatcaaacccacctgtagagaagcttttgccgctg

SEQ ID NO: 2379 - DNA, 69 bp, Artificial Sequence
  Synthetic amplicon
gatggtgcctccagcaaccgctggggagtgtgtccctgagtcatgtgggctgaatcctgactttcactc

SEQ ID NO: 2380 - DNA, 65 bp, Artificial Sequence
  Synthetic amplicon
gggtctgtgccccatgacacctggctgcccaagaagtgttccctgtgtaaatgctggcacggtca

SEQ ID NO: 2381 - DNA, 66 bp, Artificial Sequence
  Synthetic amplicon
gacgtgaaccacagggtgtcctgtcagaggagcccatctcccatctccccagctccctatctggag

SEQ ID NO: 2382 - DNA, 74 bp, Artificial Sequence
  Synthetic amplicon
tgcagcggctgattgacagtcagatggagacctcgtgccaaattacatttgagtttgtagaccaggaacagttg

SEQ ID NO: 2383 - DNA, 80 bp, Artificial Sequence
  Synthetic amplicon
gagcacaaccaaacctacgagtgcagggcccacaacagcgtggggagtggctcctgggccttcatacccatctctgcagg

SEQ ID NO: 2384 - DNA, 76 bp, Artificial Sequence
  Synthetic amplicon
gaacctgaaggactttctgcttgtcatcccctttgactgctgggagccagtccaggagtgagaccggccagatgag

SEQ ID NO: 2385 - DNA, 67 bp, Artificial Sequence
  Synthetic amplicon
taccacacccagcattcctcctgatcccagagaaatcggatctgcgaacagtggcaccagcctctag

SEQ ID NO: 2386 - DNA, 79 bp, Artificial Sequence
  Synthetic amplicon
cccaggcctctgtgtccttccctgcatttctgagtttcattctcctgcctgtagcagtgagaaaaagctcctgtcctcc

SEQ ID NO: 2387 - DNA, 76 bp, Artificial Sequence
  Synthetic amplicon
gagttcaagtgccctgacggcgaggtcatgaagaagaacatgatgttcatcaagacctgtgcctgccattacaact

SEQ ID NO: 2388 - DNA, 62 bp, Artificial Sequence
  Synthetic amplicon
ggccgagatctacaaaaacggccccgtggagggagctttctctgtgtattcggacttcctgc

SEQ ID NO: 2389 - DNA, 80 bp, Artificial Sequence
  Synthetic amplicon
gtacatgatcccctgtgagaaggtgtccaccctgcccgcgatcacactgaagctgggaggcaaaggctacaagctgtccc

SEQ ID NO: 2390 - DNA, 77 bp, Artificial Sequence
  Synthetic amplicon
gcaagttccaacctggaaaggccatcggctttgtcaaggatgtagccaacatcacaatctatgacgaggaagcgatg

SEQ ID NO: 2391 - DNA, 74 bp, Artificial Sequence
  Synthetic amplicon
gggaggcttatctcactgagtgagcagaatctggtagactgctctgggcctcaaggcaatgaaggctgcaatgg

SEQ ID NO: 2392 - DNA, 67 bp, Artificial Sequence
  Synthetic amplicon
tgtctcactgagcgagcagaatctggtggactgttcgcgtcctcaaggcaatcagggctgcaatggt

SEQ ID NO: 2393 - DNA, 76 bp, Artificial Sequence
  Synthetic amplicon
tgacaacggctttccagtacatcattgataacaagggcatcgactcagacgcttcctatccctacaaagccatgga

SEQ ID NO: 2394 - DNA, 71 bp, Artificial Sequence
  Synthetic amplicon
gaggccgttactgtggcaccgacatgccccatcctatcacatccttcagcagcgccctgacgctgagattc

SEQ ID NO: 2395 - DNA, 71 bp, Artificial Sequence
  Synthetic amplicon
atgccctggtaatgtctgcattcaacaatgacgctggctttgtggctgctcttgataaggcttgtggtcgc

SEQ ID NO: 2396 - DNA, 75 bp, Artificial Sequence
  Synthetic amplicon
aagcatcttcctgttcttggaccgcacctatgtgctgcagaactccacgctgccctccatctgggatatgggatt

SEQ ID NO: 2397 - DNA, 66 bp, Artificial Sequence
  Synthetic amplicon
gacccttgccgtctacctgaggggcctcttatgggctgggttctacccaggtgctaggaacactcc

SEQ ID NO: 2398 - DNA, 68 bp, Artificial Sequence
  Synthetic amplicon
ttcccagttgtgacatgaggaaggatctgaggctggccctcagtgtgactgagacggttgcatttagc

SEQ ID NO: 2399 - DNA, 68 bp, Artificial Sequence
  Synthetic amplicon
ggagcaaaatcgatgcagtgcttccaaggatggaccacacagaggctgcctctcccatcacttcccta

SEQ ID NO: 2400 - DNA, 67 bp, Artificial Sequence
  Synthetic amplicon
gagctacagatgcccatgccgattcttcgaaagccatgttgccagagccaacgtcaagcatctcaaa

SEQ ID NO: 2401 - DNA, 74 bp, Artificial Sequence
  Synthetic amplicon
tgcgccctttcctctgtacatatacccttaagaacgccccctccacacactgccccccagtatatgccgcattg

SEQ ID NO: 2402 - DNA, 70 bp, Artificial Sequence
  Synthetic amplicon
accagaccattgtctcagagcaggtgctggctctttcctggctactccatgttggctagcctctggtaac

SEQ ID NO: 2403 - DNA, 72 bp, Artificial Sequence
  Synthetic amplicon
tgaccgcttctaccccaatgacttgtgggtggttgtgttccagtttcagcacatcatggttggccttatcct

SEQ ID NO: 2404 - DNA, 67 bp, Artificial Sequence
  Synthetic amplicon
cagagcctgacggatgtgttcctggtgaacctacccctggctgacctggtgtttgtctgcactctgc

SEQ ID NO: 2405 - DNA, 73 bp, Artificial Sequence
  Synthetic amplicon
ccgtgttcaagaggaagctcactgccttgtggaggagttgagaaaaaccaaggcttcaccctgtgatcccact

SEQ ID NO: 2406 - DNA, 70 bp, Artificial Sequence
  Synthetic amplicon
gctgtagtgcacgagatccagagatacagtgaccttgtccccaccggtgtgccccatgcagtgaccactg

SEQ ID NO: 2407 - DNA, 79 bp, Artificial Sequence
  Synthetic amplicon
agaacaaggacaacatagatccttacatatacacaccctttggaagtggacccagaaactgcattggcatgaggtttgc

SEQ ID NO: 2408 - DNA, 76 bp, Artificial Sequence
  Synthetic amplicon
tgctcattcttgaggagcattaaggtatttcgaaactgccaagggtgctggtgcggatggacactaatgcagccac

SEQ ID NO: 2409 - DNA, 67 bp, Artificial Sequence
  Synthetic amplicon
gtgactgggctcatgcctccaagtcagagtttccctggtgccccagagacaggagcacaagtgggat

SEQ ID NO: 2410 - DNA, 77 bp, Artificial Sequence
  Synthetic amplicon
cgctgacatcatgaatgttcctcgaccggctggaggcgagtttggatatgacaaagacacatcgttgctgaaagaga

SEQ ID NO: 2411 - DNA, 69 bp, Artificial Sequence
  Synthetic amplicon
tcaccagggcaggaagtttatcatgcctatgctgaaccactcccaattacggggcctgagtatgcaacc

SEQ ID NO: 2412 - DNA, 75 bp, Artificial Sequence
  Synthetic amplicon
aaatgtcctcctcgactgctccgcggagtccgaccgaggagttccagtgatcaagtggaagaaagatggcattca

SEQ ID NO: 2413 - DNA, 67 bp, Artificial Sequence
  Synthetic amplicon
gaaggccactatcatcctccttctgcttgcacaagtttcctgggctggaccgtttcaacagagaggc

SEQ ID NO: 2414 - DNA, 66 bp, Artificial Sequence
  Synthetic amplicon
ccatagcgtctactgctccaccaagggtgccctggacatgctgaccaaggtgatggccctagagct

SEQ ID NO: 2415 - DNA, 67 bp, Artificial Sequence
  Synthetic amplicon
cagagcccagacaccatgaacgcaagtgaattccgaaggagagggaaggagatggtggattacgtgg

SEQ ID NO: 2416 - DNA, 68 bp, Artificial Sequence
  Synthetic amplicon
gatggcctcaggtggtaactttctcacaggccttggccacagatctgatcattacaattgcgtcagca

SEQ ID NO: 2417 - DNA, 70 bp, Artificial Sequence
  Synthetic amplicon
cttgtggagatcacccaatcaggttctatgcccgggactcgggcctgctcaagtttgagatccaggcggg

SEQ ID NO: 2418 - DNA, 78 bp, Artificial Sequence
  Synthetic amplicon
gggagaacgggatcaataggatcggaaacctgctggtgcccaatgagaattactgcaagtttgaggactggctgatgc

SEQ ID NO: 2419 - DNA, 73 bp, Artificial Sequence
  Synthetic amplicon
cacaatggcggctctgaagagttggctgtcgcgcagcgtaacttcattcttcaggtacagacagtgtttgtgt

SEQ ID NO: 2420 - DNA, 62 bp, Artificial Sequence
  Synthetic amplicon
caagcagtcaaggagaaccagaagcggcgggagacagaagaaaagatgaggcgagcaaaact

SEQ ID NO: 2421 - DNA, 68 bp, Artificial Sequence
  Synthetic amplicon
tccaattccagcatcactgtggagaaaagctgtttgtctccccagcatactttatcgccttcactgcc

SEQ ID NO: 2422 - DNA, 66 bp, Artificial Sequence
  Synthetic amplicon
cagctacactgtcgcagtccgctgctgagcctcccacactcatctcccctcaagctccagcctcat

SEQ ID NO: 2423 - DNA, 68 bp, Artificial Sequence
  Synthetic amplicon
gattcagacgaggatgagccttgtgccatcagtggcaaatggactttccaaagggacagcaagaggtg

SEQ ID NO: 2424 - DNA, 67 bp, Artificial Sequence
  Synthetic amplicon
cacggaggtataaggcaggagcctacctggacatccctgctcagccccgcggctggaccttccttct

SEQ ID NO: 2425 - DNA, 72 bp, Artificial Sequence
  Synthetic amplicon
ggactccagatgccaggagccctgctgcccacatgcaaggaccagcatctcctgagaggacgcctgggctta

SEQ ID NO: 2426 - DNA, 70 bp, Artificial Sequence
  Synthetic amplicon
aaagaatggcaccatgcagcccaccatgtcatgggtccacctttgcgaccagacccctcaacacccgact

SEQ ID NO: 2427 - DNA, 83 bp, Artificial Sequence
  Synthetic amplicon
tgcacagagggtgtgggttacaccaatgcttccaacaatttgtttgcttgcctcccatgtacagcttgtaaatcagatgaaga

SEQ ID NO: 2428 - DNA, 84 bp, Artificial Sequence
  Synthetic amplicon
ctctgagacagtgcttcgatgactttgcagacttggtgccctttgactcctgggagccgctcatgaggaagttgggcctcatgg

SEQ ID NO: 2429 - DNA, 76 bp, Artificial Sequence
  Synthetic amplicon
agacatcagctcctggttcaacgaggccattgacttcatagactccatcaagaatgctggaggaagggtgtttgtc

SEQ ID NO: 2430 - DNA, 77 bp, Artificial Sequence
  Synthetic amplicon
cgtcctaatcaacgtgcctatggcgggaccacgctcggagcctgcctcttctgcgactgttactttttctttgcggg

SEQ ID NO: 2431 - DNA, 75 bp, Artificial Sequence
  Synthetic amplicon
actccctctacccttgagcaagggcaggggtccctgagctgttcttctgccccatactgaaggaactgaggcctg

SEQ ID NO: 2432 - DNA, 66 bp, Artificial Sequence
  Synthetic amplicon
cgctcctgtttttctcatctgtgcagtgggttttgattcccaccatggccatcacccagtttcggt

SEQ ID NO: 2433 - DNA, 66 bp, Artificial Sequence
  Synthetic amplicon
gctcctgctcctgtgctggggcccaggtggcataagtggaaataaactcaagctgatgcttcaaaa

SEQ ID NO: 2434 - DNA, 72 bp, Artificial Sequence
  Synthetic amplicon
acgagtccattgccttcttttataaccgaagtggaaagcatcttgccacagaatggaacacagtcagcaagc

SEQ ID NO: 2435 - DNA, 73 bp, Artificial Sequence
  Synthetic amplicon
tgccacctggacatcatttgggtcaacactcccgagcacgttgttccgtatggacttggaagccctaggtcca

SEQ ID NO: 2436 - DNA, 79 bp, Artificial Sequence
  Synthetic amplicon
cgacaaggagtgcgtctacttctgccacttggacatcatctgggtgaacactcctgaacagacagctccttacggcctg

SEQ ID NO: 2437 - DNA, 76 bp, Artificial Sequence
  Synthetic amplicon
tttcctcaaatttgcctcaagatggaaaccctttgcctcagggcatccttttggctggcactggttggatgtgtaa

SEQ ID NO: 2438 - DNA, 72 bp, Artificial Sequence
  Synthetic amplicon
actgtgaactgcctggtgcagtgtccacatgacaaaggggcaggtagcaccctctctcacccatgctgtggt

SEQ ID NO: 2439 - DNA, 67 bp, Artificial Sequence
  Synthetic amplicon
cgagtggagactggtgttctcaaacccggtatggtggtcacctttgctccagtcaacgttacaacgg

SEQ ID NO: 2440 - DNA, 66 bp, Artificial Sequence
  Synthetic amplicon
ggagcccgtatcctggagctccctcaaccccaagttcctgagtgggaagggcttggtgatctatcc

SEQ ID NO: 2441 - DNA, 73 bp, Artificial Sequence
  Synthetic amplicon
tgacattatcatcccgctaaggactgcggacagcgtcttctgccctcactacgagaaggtcagcggggactac

SEQ ID NO: 2442 - DNA, 84 bp, Artificial Sequence
  Synthetic amplicon
ctttgccttgctctgtcacagtgaagtcagccagagcagggctgttaaactctgtgaaatttgtcataagggtgtcaggtattt

SEQ ID NO: 2443 - DNA, 62 bp, Artificial Sequence
  Synthetic amplicon
tgtcgatggacttccagaaccacctgggcagctgccaaaagtgtgatccaagctgtcccaat

SEQ ID NO: 2444 - DNA, 68 bp, Artificial Sequence
  Synthetic amplicon
gctggtcctctactgcgggagccggctgggcaaatactacgtcaaggagaggtctaaggcaatggtgg

SEQ ID NO: 2445 - DNA, 76 bp, Artificial Sequence
  Synthetic amplicon
gtccccgctgcagatctctgacccgttcggatcctttcctcactcgcccaccatggacaactaccctaagctggag

SEQ ID NO: 2446 - DNA, 67 bp, Artificial Sequence
  Synthetic amplicon
ccctcacggactctcagcgcgttcgcttcaccaaggagatcaagggcctgaaggtggaagtcaccca

SEQ ID NO: 2447 - DNA, 66 bp, Artificial Sequence
  Synthetic amplicon
ggcggtgaagagtcacagtttgagatggacatttaaagcaccagccatcgtgtggagcactaccaa

SEQ ID NO: 2448 - DNA, 66 bp, Artificial Sequence
  Synthetic amplicon
aggtcttgtgcaagaggagccctcgctcttctgttccttctcggcaccacctggatctttggggtt

SEQ ID NO: 2449 - DNA, 73 bp, Artificial Sequence
  Synthetic amplicon
aggcactgagggtggaaaaaatgcaagcacttcagcaaccagccggtcttattccagtattattttgccggtg

SEQ ID NO: 2450 - DNA, 75 bp, Artificial Sequence
  Synthetic amplicon
gctagtactttgatgctcccttgatggggtccagagagcctccctgcagccaccagacttggcctccagctgttc

SEQ ID NO: 2451 - DNA, 67 bp, Artificial Sequence
  Synthetic amplicon
tccttggcttacctgacctcttgctgtctctgctcgccctcctttctgtgccctactcattggggtt

SEQ ID NO: 2452 - DNA, 67 bp, Artificial Sequence
  Synthetic amplicon
cacctacacggagaacggacaagtcaagagcatagtggccaccgatcatgaaccaacagatgccagg

SEQ ID NO: 2453 - DNA, 67 bp, Artificial Sequence
  Synthetic amplicon
ctcctgcgcactaataccttcaggccaaccatgccagaggaagttaccagacccaattatccaggga

SEQ ID NO: 2454 - DNA, 72 bp, Artificial Sequence
  Synthetic amplicon
aagccttggagggtttcattgccgtggtgacccaagatggcgacatgatctttctgtcagaaaacatcagca

SEQ ID NO: 2455 - DNA, 66 bp, Artificial Sequence
  Synthetic amplicon
tcagtgccatacgctctcactctctccttccctctggctctgtgcctctgctacctggagcccaag

SEQ ID NO: 2456 - DNA, 72 bp, Artificial Sequence
  Synthetic amplicon
cgcctgttcaccaagattgacaccattgcgcccgatgagatcaccgtcagcagcgacttcgaggcacgccac

SEQ ID NO: 2457 - DNA, 67 bp, Artificial Sequence
  Synthetic amplicon
ccttgggagggaagatccctgtgagatggacagctccagaggccatcgcctaccgcaagttcacttc

SEQ ID NO: 2458 - DNA, 66 bp, Artificial Sequence
  Synthetic amplicon
caaccaggcagctccatcggcagtgtccatcatgcatcaggtgagccgcaccgtggacagcattac

SEQ ID NO: 2459 - DNA, 77 bp, Artificial Sequence
  Synthetic amplicon
tgaacggggtatcctccttagccacggggcccgtcccatttgagcctgtcaatgtcaccactgaccgagaggtacct

SEQ ID NO: 2460 - DNA, 84 bp, Artificial Sequence
  Synthetic amplicon
cagtgccagcaatgacatctcaggggccagaggaactgtccagagagcaactctgagatctaaggatgtcacagggccaacttg

SEQ ID NO: 2461 - DNA, 81 bp, Artificial Sequence
  Synthetic amplicon
cggttatgtcatgccagatacacacctcaaaggtactccctcctcccgggaaggcaccctttcttcagtgggtctcagttc

SEQ ID NO: 2462 - DNA, 86 bp, Artificial Sequence
  Synthetic amplicon
tggctcttaatcagtttcgttacctgcctctggagaatttacgcattattcgtgggacaaaactttatgaggatcgatatgccttg

SEQ ID NO: 2463 - DNA, 67 bp, Artificial Sequence
  Synthetic amplicon
gtccaggtggatgtgaaagatccccagcaggccctcaaggagctggctaagatgtgtatcctggccg

SEQ ID NO: 2464 - DNA, 67 bp, Artificial Sequence
  Synthetic amplicon
ctgctggagtacgagcgacagctggtgctggaactgctcgacactgacgggctagtagtgtgcgccc

SEQ ID NO: 2465 - DNA, 91 bp, Artificial Sequence
  Synthetic amplicon
ataacaaagtgtagctctgacatgaatggctattgtttgcatggacagtgcatctatctggtggacatgagtcaaaactactgcaggtgtg

SEQ ID NO: 2466 - DNA, 70 bp, Artificial Sequence
  Synthetic amplicon
ccaacactaggctccccaccagccatatgccttctcatctgggcacttactactaaagacctggcggagg

SEQ ID NO: 2467 - DNA, 67 bp, Artificial Sequence
  Synthetic amplicon
acggatcacagtggaggaagcgctggctcacccctacctggagcagtactatgacccgacggatgag

SEQ ID NO: 2468 - DNA, 68 bp, Artificial Sequence
  Synthetic amplicon
agttcttgacccctggtcctgtctccagcccgtcttggcttatccactttgactcctttgagccgttt

SEQ ID NO: 2469 - DNA, 70 bp, Artificial Sequence
  Synthetic amplicon
acccccagaccggatcaggcaagctggccctcatgtccccttcacggtgtttgaggaagtctgccctaca

SEQ ID NO: 2470 - DNA, 67 bp, Artificial Sequence
  Synthetic amplicon
ccagcaccattgttgaagatccccagaccaagtgtgaatacatgctcaactcgatgcccaagagact

SEQ ID NO: 2471 - DNA, 77 bp, Artificial Sequence
  Synthetic amplicon
gctgcatgtctggaaggtaactgtgctgagggtctgggtacgaactaccgagggcatgtgaacatcacccggtcagg

SEQ ID NO: 2472 - DNA, 73 bp, Artificial Sequence
  Synthetic amplicon
gtgaaggatgtgaagcagacgtacttggcacgggtcttctcctacccggcagggaatgtggagagcaccggtt

SEQ ID NO: 2473 - DNA, 66 bp, Artificial Sequence
  Synthetic amplicon
gggtccaaagtgatccaaaacgaattcacggtgggggaggaatgtgagctggagacaatgacaggg

SEQ ID NO: 2474 - DNA, 72 bp, Artificial Sequence
  Synthetic amplicon
ggagacaaagtggtcatcaggactctcagcacattcaagaacacggagattagtttccagctgggagaagag

SEQ ID NO: 2475 - DNA, 66 bp, Artificial Sequence
  Synthetic amplicon
ctgaccagaaccacggcttatccggcctgtccacgaaccacttatacacccacatgacccacttcc

SEQ ID NO: 2476 - DNA, 91 bp, Artificial Sequence
  Synthetic amplicon
ggattgctcaacaaccatgctgggcatctggaccctcctacctctggttcttacgtctgttgctagattatcgtccaaaagtgttaatgcc

SEQ ID NO: 2477 - DNA, 80 bp, Artificial Sequence
  Synthetic amplicon
gcactttgggattctttccattatgattctttgttacaggcaccgagaatgttgtattcagtgagggtcttcttacatgc

SEQ ID NO: 2478 - DNA, 73 bp, Artificial Sequence
  Synthetic amplicon
ccccagtttcaacgagacttcatttcattgctccctaaagagttggcactctatgtgctttcattcctggaac

SEQ ID NO: 2479 - DNA, 73 bp, Artificial Sequence
  Synthetic amplicon
tgccatcctgtttctgtatggaattgtcctcaccctcctctactgtcgactgaagatccaagtgcgaaaggca

SEQ ID NO: 2480 - DNA, 67 bp, Artificial Sequence
  Synthetic amplicon
gtctccagtggaagggaaaagcccatgatcttcaagcagggaagccccagtgagtagctgcattcct

SEQ ID NO: 2481 - DNA, 77 bp, Artificial Sequence
  Synthetic amplicon
ggatgattaccttgacctctttggggaccccagtgtgaccggcaaaattggcactgacatccaggacaacaaatgca

SEQ ID NO: 2482 - DNA, 66 bp, Artificial Sequence
  Synthetic amplicon
gtggagaagggtacgccagggtcgctgagagactctgttctccctggagggactggttgccatgag

SEQ ID NO: 2483 - DNA, 66 bp, Artificial Sequence
  Synthetic amplicon
gacaccgacgggcttttatacggctcacagacaccaaatgaggaatgtttgttcctggaaaggctg

SEQ ID NO: 2484 - DNA, 76 bp, Artificial Sequence
  Synthetic amplicon
agatgcaggagagaggaagccttgcaaacctgcagactgctttttgcccaatatagattgggtaaggctgcaaaac

SEQ ID NO: 2485 - DNA, 67 bp, Artificial Sequence
  Synthetic amplicon
cacagctgccatacttcgacttatcaggattctggctggtggcctgcgcgagggtgcagtcttactt

SEQ ID NO: 2486 - DNA, 74 bp, Artificial Sequence
  Synthetic amplicon
cacgggacattcaccacatcgactactataaaaagacaaccaacggccgactgcctgtgaagtggatggcaccc

SEQ ID NO: 2487 - DNA, 80 bp, Artificial Sequence
  Synthetic amplicon
gagggactgttggcatgcagtgccctcccagagaccaacgttcaagcagttggtagaagacttggatcgaattctcactc

SEQ ID NO: 2488 - DNA, 67 bp, Artificial Sequence
  Synthetic amplicon
atggttgcagcccaagtcatggggaaccatgttgctgtcactgtcggaggcagcaatggacattttg

SEQ ID NO: 2489 - DNA, 67 bp, Artificial Sequence
  Synthetic amplicon
ccagtggagcgcttccatgacctgcgtcctgatgaagtggccgatttgtttcagacgacccagagag

SEQ ID NO: 2490 - DNA, 66 bp, Artificial Sequence
  Synthetic amplicon
atccagcctttgccgaatacatcctatctgccacacatccagcgtgaggtccctccagctacaagg

SEQ ID NO: 2491 - DNA, 72 bp, Artificial Sequence
  Synthetic amplicon
ggttccagctttctgtagctgtaagcattggtggccacaccacctccttacaaagcaactagaacctgcggc

SEQ ID NO: 2492 - DNA, 66 bp, Artificial Sequence
  Synthetic amplicon
acaccggtcacaacgtcatctgctcgaggaacccagtcagtgtcaggacaagacgggtcatcccag

SEQ ID NO: 2493 - DNA, 76 bp, Artificial Sequence
  Synthetic amplicon
ctgccctgactgaatgtgttctgtcactcagctttgcttccgacacctctgtttcctcttcccctttctcctcgta

SEQ ID NO: 2494 - DNA, 82 bp, Artificial Sequence
  Synthetic amplicon
ctccttcacacagaacctttcatttattgtacaacatcacactcaccctaacctactggcggacagcgatcccagtttgcct

SEQ ID NO: 2495 - DNA, 75 bp, Artificial Sequence
  Synthetic amplicon
ggctcctgaatctatctttgacaaaatctacagcaccaagagcgacgtgtggtcttacggagtattgctgtggga

SEQ ID NO: 2496 - DNA, 71 bp, Artificial Sequence
  Synthetic amplicon
tgggtccaagatgcaaggcttgctggagcgcgtgaacacggagatacactttgtcaccaaatgtgcctttc

SEQ ID NO: 2497 - DNA, 69 bp, Artificial Sequence
  Synthetic amplicon
accaagaagctgaggacctgtggctgagcccgctgaccatggaagatcttgtctgctacagcttccagg

SEQ ID NO: 2498 - DNA, 69 bp, Artificial Sequence
  Synthetic amplicon
ggaagtgacagacgtgaaggtcaccatcatgtggacaccgcctgagagtgcagtgaccggctaccgtgt

SEQ ID NO: 2499 - DNA, 67 bp, Artificial Sequence
  Synthetic amplicon
gaacgccaagcaccacaaggaaaagccaggccccgaggacaagttgcatgagcagtgtcgaccctgg

SEQ ID NO: 2500 - DNA, 67 bp, Artificial Sequence
  Synthetic amplicon
cgagccctttgatgacttcctgttcccagcatcatccaggcccagtggctctgagacagcccgctcc

SEQ ID NO: 2501 - DNA, 66 bp, Artificial Sequence
  Synthetic amplicon
agcgctagagactgtggaccgcctgacggagtccctggatttcactgactatgcctcccggatcat

SEQ ID NO: 2502 - DNA, 75 bp, Artificial Sequence
  Synthetic amplicon
ttggtacctgtgggttagcatcaagttctccccagggtagaattcaatcagagctccagtttgcatttggatgtg

SEQ ID NO: 2503 - DNA, 72 bp, Artificial Sequence
  Synthetic amplicon
gtaagtcggatgagcctgtctgtgccagtgacaatgccacttatgccagcgagtgtgccatgaaggaagctg

SEQ ID NO: 2504 - DNA, 78 bp, Artificial Sequence
  Synthetic amplicon
tggatcctcacctggtcggtgctgtgctgcgcttccaccttcttcactgtcaccacgtacttggtagacatgcagcgc

SEQ ID NO: 2505 - DNA, 68 bp, Artificial Sequence
  Synthetic amplicon
tcagcagcaagggcatcatggaggaggatgaggcctgcgggcgccagtacacgctcaagaaaaccacc

SEQ ID NO: 2506 - DNA, 70 bp, Artificial Sequence
  Synthetic amplicon
accctcgacaagaccacactttgggacttgggagctggggctgaagttgctctgtacccatgaactccca

SEQ ID NO: 2507 - DNA, 68 bp, Artificial Sequence
  Synthetic amplicon
aacatgtcatggtccgtgtgggaggaggctgggaaacttttgcagggtatttgttgaaacacgacccc

SEQ ID NO: 2508 - DNA, 75 bp, Artificial Sequence
  Synthetic amplicon
caaaggagctcactgtggtgtctgtgttccaaccactgaatctggaccccatctgtgaataagccattctgactc

SEQ ID NO: 2509 - DNA, 67 bp, Artificial Sequence
  Synthetic amplicon
gatctcggcttggacgaaccttgacaggatgggtgcagcgaactttccagagcacccaggcagctac

SEQ ID NO: 2510 - DNA, 66 bp, Artificial Sequence
  Synthetic amplicon
gctgtcaatagcaccggaaactgctatgtctggaatctgacggggggcattggtgacgaggtgacc

SEQ ID NO: 2511 - DNA, 83 bp, Artificial Sequence
  Synthetic amplicon
gcatgggaaccatcaaccagcaggccatggaccaacttcactatgtgacagagctgacagatcgaatcaaggcaaactcctca

SEQ ID NO: 2512 - DNA, 71 bp, Artificial Sequence
  Synthetic amplicon
ctgttgcaggaaggcattgatcatctcctggcccagcatgttgctcatctctttattagagacccactgac

SEQ ID NO: 2513 - DNA, 85 bp, Artificial Sequence
  Synthetic amplicon
tgtagaatcaaactcttcatcatcaactagaagtgcagttgacatggcctgttcagtccttggagttgcacagctggattctgtg

SEQ ID NO: 2514 - DNA, 69 bp, Artificial Sequence
  Synthetic amplicon
tccgggttaagaacaagcccctggggccagcagggtctgagaatgaaattcccactcatgttttgccac

SEQ ID NO: 2515 - DNA, 68 bp, Artificial Sequence
  Synthetic amplicon
gttcactgggggtgtatggggtagatgggtggagagggaggggataagagaggtgcatgttggtattt

SEQ ID NO: 2516 - DNA, 68 bp, Artificial Sequence
  Synthetic amplicon
taccattgcaaggtgcccagatgctgcagatgctggagaaatccttgaggaagagcctcccagcatcc

SEQ ID NO: 2517 - DNA, 67 bp, Artificial Sequence
  Synthetic amplicon
gttcgctacgaggattgagcgtctccacccagtaagtgggcaagaggcggcaggaagtgggtacgca

SEQ ID NO: 2518 - DNA, 72 bp, Artificial Sequence
  Synthetic amplicon
gaacgtgcctgactttgacttccctcccgaattctatgagcatgccaaggctctgtgggaggatgaaggagt

SEQ ID NO: 2519 - DNA, 68 bp, Artificial Sequence
  Synthetic amplicon
tgatgcgcctggaaacagtcagcaggcaactccgaaggacaacgagataagcacctttcacaacctcg

SEQ ID NO: 2520 - DNA, 67 bp, Artificial Sequence
  Synthetic amplicon
gcttatgaccgaccccaagctcatcacctggtctccggtgtgtcgcaacgatgttgcctggaacttt

SEQ ID NO: 2521 - DNA, 75 bp, Artificial Sequence
  Synthetic amplicon
cacacagatctcctactccatccagtcctgaggagccttaggatgcagcatgccttcaggagacactgctggacc

SEQ ID NO: 2522 - DNA, 69 bp, Artificial Sequence
  Synthetic amplicon
gctctaggtccaattgttctgctctaactgatacctcaaccttggggccagcatctcccactgcctcca

SEQ ID NO: 2523 - DNA, 76 bp, Artificial Sequence
  Synthetic amplicon
tcccactgaagccctttcagttgcggttgaagaaggactcgcttggaggaaaaaaggatgtttacgcctgggcact

SEQ ID NO: 2524 - DNA, 67 bp, Artificial Sequence
  Synthetic amplicon
ccatctgcatccatcttgtttgggctccccacccttgagaagtgcctcagataataccctggtggcc

SEQ ID NO: 2525 - DNA, 73 bp, Artificial Sequence
  Synthetic amplicon
cgaaaagatgctgaacagtgacaaatccaactgaccagaagggaggaggaagctcactggtggctgttcctga

SEQ ID NO: 2526 - DNA, 86 bp, Artificial Sequence
  Synthetic amplicon
aagctatgaggaaaagaagtacacgatgggggacgctcctgattatgacagaagccagtggctgaatgaaaaattcaagctgggcc

SEQ ID NO: 2527 - DNA, 76 bp, Artificial Sequence
  Synthetic amplicon
caatgccatcttgcgctacatcgctcgcaagcacaacatgtgtggtgagactgaagaagaaaagattcgagtggac

SEQ ID NO: 2528 - DNA, 76 bp, Artificial Sequence
  Synthetic amplicon
gagaccctgctgtcccagaaccagggaggcaagaccttcattgtgggagaccagatctccttcgctgactacaacc

SEQ ID NO: 2529 - DNA, 66 bp, Artificial Sequence
  Synthetic amplicon
caccatccccaccctgtcttccacagccgcctgaaagccacaatgagaatgatgcacactgaggcc

SEQ ID NO: 2530 - DNA, 79 bp, Artificial Sequence
  Synthetic amplicon
gaaagagtttccctatccatgctatgacccagccacacgcgaaggtgaccttaaacttttacagctgacggaaaaagca

SEQ ID NO: 2531 - DNA, 66 bp, Artificial Sequence
  Synthetic amplicon
ccaccagacaagaccgattcgctggcctccatttcttcaacccagtgcctgtcatgaaacttgtgg

SEQ ID NO: 2532 - DNA, 76 bp, Artificial Sequence
  Synthetic amplicon
ccacccaaggtcacgactactccaattgtcacaactgttccaaccgtcacgactgttcgaacgagcaccactgttc

SEQ ID NO: 2533 - DNA, 74 bp, Artificial Sequence
  Synthetic amplicon
caagtaccacagcgatgactacattaaattcttgcgctccatccgtccagataacatgtcggagtacagcaagc

SEQ ID NO: 2534 - DNA, 84 bp, Artificial Sequence
  Synthetic amplicon
aggctgctggaggtcatctccgtgtgtgattgccccagaggccgtttcttggccgccatctgccaagactgtggccgcaggaag

SEQ ID NO: 2535 - DNA, 70 bp, Artificial Sequence
  Synthetic amplicon
cggtgtgagaagtgcagcaagccctgtgcccgagtgtgctatggtctgggcatggagcacttgcgagagg

SEQ ID NO: 2536 - DNA, 76 bp, Artificial Sequence
  Synthetic amplicon
ctcaggtctgcccctacaatctctatgctgagcagctctcaggatcggctttcacttgtccacggagcaccaataa

SEQ ID NO: 2537 - DNA, 65 bp, Artificial Sequence
  Synthetic amplicon
ccgaaatccagatgatgatgctcatggaccctggtgctacacgggaaatccactcattccttggg

SEQ ID NO: 2538 - DNA, 72 bp, Artificial Sequence
  Synthetic amplicon
caggacacaagtgccagattgcgggctggggccacttggatgagaacgtgagcggctactccagctccctgc

SEQ ID NO: 2539 - DNA, 82 bp, Artificial Sequence
  Synthetic amplicon
tgaacataaagtctgcaacatggaaggtattgcactgcacaggccacattcacgtatatgataccaacagtaaccaacctca

SEQ ID NO: 2540 - DNA, 66 bp, Artificial Sequence
  Synthetic amplicon
tgttggccaggtctcactgcagcctgcccgaggctaactggctagagcctccaggccctatgatgc

SEQ ID NO: 2541 - DNA, 67 bp, Artificial Sequence
  Synthetic amplicon
aaaaaggcgaagaaggcaggcgcaactgctgggaaacgcaaagcatccggacccccagtatctgagc

SEQ ID NO: 2542 - DNA, 78 bp, Artificial Sequence
  Synthetic amplicon
cttgtgagggactgagatgcaggatttcttcacgcctcccctttgtgacttcaagagcctctggcatctctttctgca

SEQ ID NO: 2543 - DNA, 78 bp, Artificial Sequence
  Synthetic amplicon
cgccctgaagacagaatgttccatatcagagctgtgatcttgagagccctctccttggctttcctgctgagtctccga

SEQ ID NO: 2544 - DNA, 73 bp, Artificial Sequence
  Synthetic amplicon
tccatgatggttctgcaggtttctgcggccccccggacagtggctctgacggcgttactgatggtgctgctca

SEQ ID NO: 2545 - DNA, 67 bp, Artificial Sequence
  Synthetic amplicon
ggtctgctcggtgacagatttctatccaggccagatcaaagtccggtggtttcggaatgatcaggag

SEQ ID NO: 2546 - DNA, 76 bp, Artificial Sequence
  Synthetic amplicon
catctttcctcctgtggtcaacatcacatggctgagcaatgggcagtcagtcacagaaggtgtttctgagaccagc

SEQ ID NO: 2547 - DNA, 71 bp, Artificial Sequence
  Synthetic amplicon
tggcctgtccattggtgatgttgcgaagaaactgggagagatgtggaataacactgctgcagatgacaagc

SEQ ID NO: 2548 - DNA, 84 bp, Artificial Sequence
  Synthetic amplicon
agcaggagcgaccaactgatcgcacacatgctttgtttggatatggagtgaacacaattatgtaccaaatttaacttggcaaac

SEQ ID NO: 2549 - DNA, 70 bp, Artificial Sequence
  Synthetic amplicon
caggcagatggacaccaacaatgacggcaaactgtccttggaagaattcatcagaggtgccaagagcgac

SEQ ID NO: 2550 - DNA, 78 bp, Artificial Sequence
  Synthetic amplicon
agctgaagacggccaagatcaaggtgaaggagaacattgatgccctggaggagctgaaaatcctggtggactacgacg

SEQ ID NO: 2551 - DNA, 69 bp, Artificial Sequence
  Synthetic amplicon
ccaacctgcctcaagagctgctgcaggcctacggcaaggactacatcgagcacttgcatgggcagttcc

SEQ ID NO: 2552 - DNA, 66 bp, Artificial Sequence
  Synthetic amplicon
gcattgtgaccagcacctacggctggacagccaatatggagcggatcatgaaagcccaggcacttc

SEQ ID NO: 2553 - DNA, 70 bp, Artificial Sequence
  Synthetic amplicon
ctgctgcgacagtccactacctttttcgagagtgactcccgttgtcccaaggcttcccagagcgaacctg

SEQ ID NO: 2554 - DNA, 73 bp, Artificial Sequence
  Synthetic amplicon
cctccctctggtggtgcttcctcagggcccaccattgaagaggttgattaagccaaccaagtgtagatgtagc

SEQ ID NO: 2555 - DNA, 84 bp, Artificial Sequence
  Synthetic amplicon
ccgactggaggagcataaaagcgcagccgagcccagcgccccgcacttttctgagcagacgtccagagcagagtcagccagcat

SEQ ID NO: 2556 - DNA, 66 bp, Artificial Sequence
  Synthetic amplicon
gagtacgtgtgccgagtgttgggcagctccgtgcctctagaggcctctgtcctggtcaccattgag

SEQ ID NO: 2557 - DNA, 66 bp, Artificial Sequence
  Synthetic amplicon
tcgaattgtttgggcactgatgaggactcccaggacagctctgatggaataccgtcagcaccacgc

SEQ ID NO: 2558 - DNA, 78 bp, Artificial Sequence
  Synthetic amplicon
tggctgtggagttcaaatgtcgatgctaccctggctggcaggcaccgtggtgtgagcggaagagcatgtggtgattgg

SEQ ID NO: 2559 - DNA, 67 bp, Artificial Sequence
  Synthetic amplicon
caaccatgcactcccagtctacgtcttcacacgacccacctacagccgcaggctcacggggcttagt

SEQ ID NO: 2560 - DNA, 67 bp, Artificial Sequence
  Synthetic amplicon
tatgtccgcctcacacaccggagatctgggaggttcctgtcccaggatgaccttgtgcagtccattg

SEQ ID NO: 2561 - DNA, 68 bp, Artificial Sequence
  Synthetic amplicon
gcagacagtgaccatctacagctttccggcgcccaacgtgattctgacgaagccagaggtctcagaag

SEQ ID NO: 2562 - DNA, 62 bp, Artificial Sequence
  Synthetic amplicon
ggtcatcctgacactgcaacccactttggtggctgtgggcaagtccttcaccattgagtgca

SEQ ID NO: 2563 - DNA, 67 bp, Artificial Sequence
  Synthetic amplicon
gccttcaatctcagcaacgtgactggcaacagtcggatcctctgctcagtgtactgcaatggctctc

SEQ ID NO: 2564 - DNA, 70 bp, Artificial Sequence
  Synthetic amplicon
agaaccgcaaggtgagcaaggtggagattctccagcacgtcatcgactacatcagggaccttcagttgga

SEQ ID NO: 2565 - DNA, 76 bp, Artificial Sequence
  Synthetic amplicon
aacgactgctactccaagctcaaggagctggtgcccagcatcccccagaacaagaaggtgagcaagatggaaatcc

SEQ ID NO: 2566 - DNA, 80 bp, Artificial Sequence
  Synthetic amplicon
cttcaccaaatcccttcctggagactaaacctggtgctcaggagcgaaggactgtgaacttgtggcctgaagagccagag

SEQ ID NO: 2567 - DNA, 71 bp, Artificial Sequence
  Synthetic amplicon
ctctccggattgaccaagttcatcctgggctccattgggtctgccattgcggctgtcattgcgaggttcta

SEQ ID NO: 2568 - DNA, 76 bp, Artificial Sequence
  Synthetic amplicon
tccggagctgtgatctaaggaggctggagatgtattgcgcacccctcaagcctgccaagtcagctcgctctgtccg

SEQ ID NO: 2569 - DNA, 83 bp, Artificial Sequence
  Synthetic amplicon
gcatggtagccgaagatttcacagtcaaaatcggagattttggtatgacgcgagatatctatgagacagactattaccggaaa

SEQ ID NO: 2570 - DNA, 72 bp, Artificial Sequence
  Synthetic amplicon
ccgtgcttccggacaacttccccagataccccgtgggcaagttcttccaatatgacacctggaagcagtcca

SEQ ID NO: 2571 - DNA, 73 bp, Artificial Sequence
  Synthetic amplicon
gtggacagcaccatgaacatgttgggcgggggaggcagtgctggccggaagcccctcaagtcgggtatgaagg

SEQ ID NO: 2572 - DNA, 66 bp, Artificial Sequence
  Synthetic amplicon
acatcccaacgcatgctcctggagctcacagccttctgtggtgtcatttctgaaacaagggcgtgg

SEQ ID NO: 2573 - DNA, 69 bp, Artificial Sequence
  Synthetic amplicon
tggacaagtacgggatgaagctgccaggcatggagtacgttgacggggactttcagtgccacaccttcg

SEQ ID NO: 2574 - DNA, 77 bp, Artificial Sequence
  Synthetic amplicon
tgaaccgcagagaccaacagaggaatccaggcacctctaccacgccctcccagcccaattctgcgggtgtccaagac

SEQ ID NO: 2575 - DNA, 71 bp, Artificial Sequence
  Synthetic amplicon
gcggtgattcggaaattcgcgaattcctctggtcctcatccaggtgcgcgggaagcaggtgcccaggagag

SEQ ID NO: 2576 - DNA, 70 bp, Artificial Sequence
  Synthetic amplicon
aaggaaccatctcactgtgtgtaaacatgacttccaagctggccgtggctctcttggcagccttcctgat

SEQ ID NO: 2577 - DNA, 79 bp, Artificial Sequence
  Synthetic amplicon
ggcgctgtcatcgatttcttccctgtgaaaacaagagcaaggccgtggagcaggtgaagaatgcctttaataagctcca

SEQ ID NO: 2578 - DNA, 66 bp, Artificial Sequence
  Synthetic amplicon
tggaaggttccacaagtcaccctgtgatcaacagtacccgtatgggacaaagctgcaaggtcaaga

SEQ ID NO: 2579 - DNA, 79 bp, Artificial Sequence
  Synthetic amplicon
ggctgggtaccaatgctgcaggtcaacagctatgctggtaggctcctgccagtgtggaaccactgactactggctctca

SEQ ID NO: 2580 - DNA, 67 bp, Artificial Sequence
  Synthetic amplicon
agctgaggaagatgctggttccctgcccacagaccttccaggagaatgacctgagcaccttctttcc

SEQ ID NO: 2581 - DNA, 72 bp, Artificial Sequence
  Synthetic amplicon
cctgaaccttccaaagatggctgaaaaagatggatgcttccaatctggattcaatgaggagacttgcctggt

SEQ ID NO: 2582 - DNA, 74 bp, Artificial Sequence
  Synthetic amplicon
ggcctaatgttccagatccttcaaagagtcatattgcccagtggtcacctcacactcctccaaggcacaatttt

SEQ ID NO: 2583 - DNA, 63 bp, Artificial Sequence
  Synthetic amplicon
agccatcactctcagtgcagccaggtcctatcgtggcccctgaggagaccctgactctgcagt

SEQ ID NO: 2584 - DNA, 72 bp, Artificial Sequence
  Synthetic amplicon
gtggactcgtccaagatcaagcggcacgtgctagagtacaatgaggagcgcgatgacttcgatctggaagcc

SEQ ID NO: 2585 - DNA, 66 bp, Artificial Sequence
  Synthetic amplicon
cgccttgcacgtctagttctgggatgcatcaccatggcatatgtgtggggcaaaggtcatggagat

SEQ ID NO: 2586 - DNA, 72 bp, Artificial Sequence
  Synthetic amplicon
gtgcccgagccatatagcaggcacgtccgggtcctcactgtccttccactcaacagtcatcaaccactaccg

SEQ ID NO: 2587 - DNA, 72 bp, Artificial Sequence
  Synthetic amplicon
agcctccaggataccagcaaatggatgcggtgacaaatggcagcttagctacaaatgcctgtcagtcggaga

SEQ ID NO: 2588 - DNA, 67 bp, Artificial Sequence
  Synthetic amplicon
cagtctccgagagcggattgagttcctcaatgaggcctcggtcatgaagggcttcacctgccatcac

SEQ ID NO: 2589 - DNA, 66 bp, Artificial Sequence
  Synthetic amplicon
agagacaccagcaactgcgcaacaggaggtagaccatgccacggacatggtgagccgtgcaatgat

SEQ ID NO: 2590 - DNA, 70 bp, Artificial Sequence
  Synthetic amplicon
gtgtcagactgaagccccatccagcccgttccgcagggactagaggctttcggctttttgggacagcaac

SEQ ID NO: 2591 - DNA, 77 bp, Artificial Sequence
  Synthetic amplicon
ccatgatcctcactctgctggtggactatacactccagacctcgcttagcatggtaaatcaccggctacaaagcttc

SEQ ID NO: 2592 - DNA, 66 bp, Artificial Sequence
  Synthetic amplicon
caacgcttcagtgatcaatcccggggcgatttacagatgcaggatcggaaagaatcccggccagac

SEQ ID NO: 2593 - DNA, 75 bp, Artificial Sequence
  Synthetic amplicon
aggccagccctacattatcagagcaagagccggatagaggacaaggctcagatcttgctggactgtggagaagac

SEQ ID NO: 2594 - DNA, 69 bp, Artificial Sequence
  Synthetic amplicon
cagtgacaaacagcccttccaacccaaggaatcccacaaaagatggcgatgacgcccatgaggctaaac

SEQ ID NO: 2595 - DNA, 79 bp, Artificial Sequence
  Synthetic amplicon
gatatgattggtcgctgctttgtgctcagccaggacctggccatccgggatgagttggatggtggggaatggaagttct

SEQ ID NO: 2596 - DNA, 79 bp, Artificial Sequence
  Synthetic amplicon
actcggactgcacaagctatttttgatgacagctatttgggttattctgtggctgtcggagatttcaatggtgatggca

SEQ ID NO: 2597 - DNA, 74 bp, Artificial Sequence
  Synthetic amplicon
tcagaattggatttggctcatttgtggaaaagactgtgatgccttacattagcacaacaccagctaagctcagg

SEQ ID NO: 2598 - DNA, 78 bp, Artificial Sequence
  Synthetic amplicon
accggggagccctacatgacgaaaatacctgcaaccgttactgccgtgacgagattgagtcagtgaaagagcttaagg

SEQ ID NO: 2599 - DNA, 66 bp, Artificial Sequence
  Synthetic amplicon
caaggtgccctcagtggagctcaccaacctgtacccgtattgcgactatgagatgaaggtgtgcgc

SEQ ID NO: 2600 - DNA, 71 bp, Artificial Sequence
  Synthetic amplicon
tcgtgaaagatgaccaggaggctgtgctatgtttctacaaaaccgccaaggactgcgtcatgatgttcacc

SEQ ID NO: 2601 - DNA, 69 bp, Artificial Sequence
  Synthetic amplicon
tggcttacactggcaatggtagtttctgtggttggctgggaaatcgagtgccgcatctcacagctatgc

SEQ ID NO: 2602 - DNA, 71 bp, Artificial Sequence
  Synthetic amplicon
gtcaaaatggggagggactagggcagtttggatagctcaacaagatacaatctcactctgtggtggtcctg

SEQ ID NO: 2603 - DNA, 67 bp, Artificial Sequence
  Synthetic amplicon
ggacgttctacctgccttgaagaagacacctgacctgcggagtgagtgaccagtgtttccagagcct

SEQ ID NO: 2604 - DNA, 68 bp, Artificial Sequence
  Synthetic amplicon
gaggacgaaggcctctacacctgccaggcatgcagtgttcttggctgtgcaaaagtggaggcattttt

SEQ ID NO: 2605 - DNA, 80 bp, Artificial Sequence
  Synthetic amplicon
cggactttgggtgcgacttgacgagcggtggttcgacaagtggccttgcgggccggatcgtcccagtggaagagttgtaa

SEQ ID NO: 2606 - DNA, 66 bp, Artificial Sequence
  Synthetic amplicon
actacagcgggagcaggagctggaggtagctgcaatcaacccaaatcaccctcttgctcagatgcc

SEQ ID NO: 2607 - DNA, 66 bp, Artificial Sequence
  Synthetic amplicon
ctcctactggtcgcacacctcacctgaggacatcaactacgcgtcgcagaagcaggtgtaccggga

SEQ ID NO: 2608 - DNA, 79 bp, Artificial Sequence
  Synthetic amplicon
gtccccgggatggatgttttgccaagtcattgttggataagcgagatggtagtacaattgtcagacagcttgactgatc

SEQ ID NO: 2609 - DNA, 72 bp, Artificial Sequence
  Synthetic amplicon
gaggtcctgtctaaaccctgtgtccctgagggatctgtctcactggcatcttgttgagggccttgcacatag

SEQ ID NO: 2610 - DNA, 66 bp, Artificial Sequence
  Synthetic amplicon
ccaagcttaccacctgcacccggagagctgtgtcaccatgtgggtcccggttgtcttcctcaccct

SEQ ID NO: 2611 - DNA, 70 bp, Artificial Sequence
  Synthetic amplicon
tgagagccaggcttcttgtatgtctcaaaatgccagccttctgaaagtatacagcaaagaggaccaggat

SEQ ID NO: 2612 - DNA, 77 bp, Artificial Sequence
  Synthetic amplicon
tgagcggcagaatcaggagtaccagcggctcatggacatcaagtcgcggctggagcaggagattgccacctaccgca

SEQ ID NO: 2613 - DNA, 69 bp, Artificial Sequence
  Synthetic amplicon
tcagtggagaaggagttggaccagtcaacatctctgttgtcacaagcagtgtttcctctggatatggca

SEQ ID NO: 2614 - DNA, 71 bp, Artificial Sequence
  Synthetic amplicon
ttcagagatgaaccgggccatccagaggctgcaggctgagatcgacaacatcaagaaccagcgtgccaagt

SEQ ID NO: 2615 - DNA, 66 bp, Artificial Sequence
  Synthetic amplicon
cttgctggccaatgcctacatctacgttgtccagctgccagccaagatcctgactgcggacaatca

SEQ ID NO: 2616 - DNA, 73 bp, Artificial Sequence
  Synthetic amplicon
cagatgaggcacatggagacccaggccaaggacctgaggaatcagttgctcaactaccgttctgccatttcaa

SEQ ID NO: 2617 - DNA, 67 bp, Artificial Sequence
  Synthetic amplicon
gatgcactgcggttagcagcgctctccatcgaggaaggcaaatccggggtgctgagcgtatcctctg

SEQ ID NO: 2618 - DNA, 66 bp, Artificial Sequence
  Synthetic amplicon
caaggagactgggaggtgtctcaagtgcctgtaccacacggaaggggaacactgtcagttctgccg

SEQ ID NO: 2619 - DNA, 67 bp, Artificial Sequence
  Synthetic amplicon
actgaccaagcctgagacctactgcacccagtatggcgagtggcagatgaaatgctgcaagtgtgac

SEQ ID NO: 2620 - DNA, 80 bp, Artificial Sequence
  Synthetic amplicon
actcaagcggaaattgaagcagataggtcttatcagcacagtctccgcctcctggattcagtgtctcggcttcagggagt

SEQ ID NO: 2621 - DNA, 66 bp, Artificial Sequence
  Synthetic amplicon
tgctggacttctgcctgagcatcctgaccctctgcagctcctacatggaagtgcccacctatctca

SEQ ID NO: 2622 - DNA, 67 bp, Artificial Sequence
  Synthetic amplicon
aacacccagtttgacgcagccaacggcattgacgacgaggacagctttaacaactcccctgcactgg

SEQ ID NO: 2623 - DNA, 66 bp, Artificial Sequence
  Synthetic amplicon
atcacggtggactgcgaccagtgtaccatggtcacccagcacgggaagcccatgtttaccaaggta

SEQ ID NO: 2624 - DNA, 74 bp, Artificial Sequence
  Synthetic amplicon
aggctacacatcctgggctattggactctctgtagcagatttggcagagagtataatgaagaatcttaggcggg

SEQ ID NO: 2625 - DNA, 72 bp, Artificial Sequence
  Synthetic amplicon
gggtggagtcttctgacagctggtgcgcctgcccgggaacatcctcctggactcaatcatggcttgtggtct

SEQ ID NO: 2626 - DNA, 69 bp, Artificial Sequence
  Synthetic amplicon
agcggaaaatggcagacaatttttcgctccatgatgcgttatctgggtctggaaacccaaaccctcaag

SEQ ID NO: 2627 - DNA, 67 bp, Artificial Sequence
  Synthetic amplicon
agtacttccaccgcgtgcccttccaccgtgtggacaccatctccgtcaatggctctgtgcagctgtc

SEQ ID NO: 2628 - DNA, 67 bp, Artificial Sequence
  Synthetic amplicon
gcttcaggtgttgtgactgcagtgcctccctgtcgcaccagtactatgagaaggatgggcagctctt

SEQ ID NO: 2629 - DNA, 66 bp, Artificial Sequence
  Synthetic amplicon
tgcaaacgctggtgtcacagccagccccccaactgacctcatctggaagaaccagaactcgtgggg

SEQ ID NO: 2630 - DNA, 74 bp, Artificial Sequence
  Synthetic amplicon
ggctgccagcagaacatcggggaccgctacttcctgaaggccatcgaccagtactggcacgaggactgcctgag

SEQ ID NO: 2631 - DNA, 66 bp, Artificial Sequence
  Synthetic amplicon
ccaatgggagaacaacgggcaggtgttcagcttgctgagcctgggctcacagtaccagcctcagcg

SEQ ID NO: 2632 - DNA, 66 bp, Artificial Sequence
  Synthetic amplicon
ggctgtagactgggtttccagaaagctctactggttggatgcccgcctggatggcctctttgtctc

SEQ ID NO: 2633 - DNA, 71 bp, Artificial Sequence
  Synthetic amplicon
ccagtgtcccaatctgtgtcctgcggatgtcgaatttgcagtggttggatatcagcagcaataacctgacc

SEQ ID NO: 2634 - DNA, 68 bp, Artificial Sequence
  Synthetic amplicon
aacggaagcctgtgactgaggctagaagctgccatcttgccatggccccgaatcatgccgtggtgtct

SEQ ID NO: 2635 - DNA, 80 bp, Artificial Sequence
  Synthetic amplicon
ttgctgcaagataacatcgctgatgctgtagcttgtgcaaagagggttgtccgtgatccacaaggcattagagcatgggt

SEQ ID NO: 2636 - DNA, 70 bp, Artificial Sequence
  Synthetic amplicon
gctgcctttggtaagaacatgtcgtccatcttgccattcacgccgccagttgtgaagagactgctgggat

SEQ ID NO: 2637 - DNA, 76 bp, Artificial Sequence
  Synthetic amplicon
ggacattactggcctgttcacaatgagcttgcattccagcctcccatttccaatcatcctgctcctgagtattggt

SEQ ID NO: 2638 - DNA, 66 bp, Artificial Sequence
  Synthetic amplicon
gttgggagcttgctgtgtctaacctccaactgctgtgctgtctgctagggtcacctcctgtttgtg

SEQ ID NO: 2639 - DNA, 67 bp, Artificial Sequence
  Synthetic amplicon
ccttcgtctgcctggagattctgttcgggggtcttgtctggattttggttgcctcctccaatgttcc

SEQ ID NO: 2640 - DNA, 76 bp, Artificial Sequence
  Synthetic amplicon
gcctttcttacccagaagcagaaggtgggagaactgaaggatgacgactttgagaagatcagtgagctgggggctg

SEQ ID NO: 2641 - DNA, 67 bp, Artificial Sequence
  Synthetic amplicon
gccctccaatgtccttatcaacaaggagggccatgtgaagatgtgtgactttggcatcagtggctac

SEQ ID NO: 2642 - DNA, 72 bp, Artificial Sequence
  Synthetic amplicon
gccggtcaggcacacaaggggcccttggagcgtggactggttggttttgccattttgttgtgtgtatgctgc

SEQ ID NO: 2643 - DNA, 67 bp, Artificial Sequence
  Synthetic amplicon
cccctcttggatctgttgagtttctttgttgaagaagccagcatgggtgcccagttctccaagaccg

SEQ ID NO: 2644 - DNA, 77 bp, Artificial Sequence
  Synthetic amplicon
cagatggccactttgagaacattttagctgacaacagtgtgaacgaccagaccaaaatccttgtggttaatgctgcc

SEQ ID NO: 2645 - DNA, 66 bp, Artificial Sequence
  Synthetic amplicon
cgagttccagtggctgagagaagagacaggccaggtgctggaaagggggcctgtgcttcagttgca

SEQ ID NO: 2646 - DNA, 75 bp, Artificial Sequence
  Synthetic amplicon
gacttttgcccgctacctttcattccggcgtgacaacaatgagctgttgctcttcatactgaagcagttagtggc

SEQ ID NO: 2647 - DNA, 75 bp, Artificial Sequence
  Synthetic amplicon
ggagaacaatccccttgagacagaatatggcctttctgtctacaaggatcaccagaccatcaccatccaggagat

SEQ ID NO: 2648 - DNA, 82 bp, Artificial Sequence
  Synthetic amplicon
tgatggtcctatgtgtcacattcatcacaggtttcataccaacacaggcttcagcacttcctttggtgtgtttcctgtccca

SEQ ID NO: 2649 - DNA, 71 bp, Artificial Sequence
  Synthetic amplicon
cgctcagccagatgcaatcaatgccccagtcacctgctgttataacttcaccaataggaagatctcagtgc

SEQ ID NO: 2650 - DNA, 63 bp, Artificial Sequence
  Synthetic amplicon
ccaacacctttgttgcagagctgaagggtttggatccagctcgagtcaacgtccctgtcattg

SEQ ID NO: 2651 - DNA, 66 bp, Artificial Sequence
  Synthetic amplicon
ggagccgactgcaagtacaagtttgagaactggggtgcgtgtgatgggggcacaggcaccaaagtc

SEQ ID NO: 2652 - DNA, 68 bp, Artificial Sequence
  Synthetic amplicon
ctacagggacgccatcgaatccggatcttgatgctggtgtaagtgaacattcaggtgattggttggat

SEQ ID NO: 2653 - DNA, 69 bp, Artificial Sequence
  Synthetic amplicon
gtgaaatgaaacgcaccacactggacagccctttggggaagctggagctgtctggttgtgagcagggtc

SEQ ID NO: 2654 - DNA, 79 bp, Artificial Sequence
  Synthetic amplicon
acggatctaccacaccattgcatatttgacaccccttccccagccaaatagagctttgagtttttttgttggatatgga

SEQ ID NO: 2655 - DNA, 68 bp, Artificial Sequence
  Synthetic amplicon
atggtgaatgtcacccgcagcgaggcctcagagggcaacattaccgtgacatgcagggcttctggctt

SEQ ID NO: 2656 - DNA, 66 bp, Artificial Sequence
  Synthetic amplicon
ccggacagggtctacatcaactattacgacatgaacgcggccaatgtgggctggaacaactccacc

SEQ ID NO: 2657 - DNA, 72 bp, Artificial Sequence
  Synthetic amplicon
gggagatcatcgggacaactctccttttgatggacctggaggaaatcttgctcatgcttttcaaccaggccc

SEQ ID NO: 2658 - DNA, 66 bp, Artificial Sequence
  Synthetic amplicon
tggaggtgacagggaagctagacactgacactctggaggtgatgcgcaagcccaggtgtggagttc

SEQ ID NO: 2659 - DNA, 66 bp, Artificial Sequence
  Synthetic amplicon
gctgtggagctctcaggaagggccctgaggaaggcacacttgctcctgttggtccctgtccttgct

SEQ ID NO: 2660 - DNA, 86 bp, Artificial Sequence
  Synthetic amplicon
ccatgatggagaggcagacatcatgatcaactttggccgctgggagcatggcgatggatacccctttgacggtaaggacggactcc

SEQ ID NO: 2661 - DNA, 79 bp, Artificial Sequence
  Synthetic amplicon
ggatggtagcagtctagggattaacttcctgtatgctgcaactcatgaacttggccattctttgggtatgggacattcc

SEQ ID NO: 2662 - DNA, 67 bp, Artificial Sequence
  Synthetic amplicon
gagaaccaatctcaccgacaggcagctggcagaggaatacctgtaccgctatggttacactcgggtg

SEQ ID NO: 2663 - DNA, 79 bp, Artificial Sequence
  Synthetic amplicon
tcatggtgcccgtcaatgctgtgatggcgatgaagaccaagacgtatcaggtggcccacatgaagagcaaagacaatcg

SEQ ID NO: 2664 - DNA, 65 bp, Artificial Sequence
  Synthetic amplicon
aggggatgacttggacacatctgccattcgacatgactgcaattttgacaaagccatgcagtttt

SEQ ID NO: 2665 - DNA, 91 bp, Artificial Sequence
  Synthetic amplicon
tcatcctggcgatctacttcctctggcagaacctaggtccctctgtcctggctggagtcgctttcatggtcttgctgattccactcaacgg

SEQ ID NO: 2666 - DNA, 66 bp, Artificial Sequence
  Synthetic amplicon
agcgcctggaatctacaactcggagtccagtgttttcccacttgtcatcttctctccaggggctct

SEQ ID NO: 2667 - DNA, 73 bp, Artificial Sequence
  Synthetic amplicon
gatgcagaattgaggcagactttacaagaagatttacttcgtcgattcccagatcttaaccgacttgccaaga

SEQ ID NO: 2668 - DNA, 82 bp, Artificial Sequence
  Synthetic amplicon
tgattaccatcatggctcagattggctcctatgttcctgcagaagaagcgacaattgggattgtggatggcattttcacaag

SEQ ID NO: 2669 - DNA, 68 bp, Artificial Sequence
  Synthetic amplicon
tctattgggggattggtaggaaccgttaccagctggaaattcctgagaatttcaccactcgcaatttg

SEQ ID NO: 2670 - DNA, 66 bp, Artificial Sequence
  Synthetic amplicon
gtgggctgtgccaagtgtgcccagggctgtgtctgcaaaggctcatcagagaagtgccgctgctgt

SEQ ID NO: 2671 - DNA, 74 bp, Artificial Sequence
  Synthetic amplicon
gtgcacccactgcctcttcccttctcgcttgggaactctagtctcgcctcgggttgcaatggaccccaactgct

SEQ ID NO: 2672 - DNA, 74 bp, Artificial Sequence
  Synthetic amplicon
cgtgttccactgcctcttctcttctcgcttgggaactccagtctcacctcggcttgcaatggaccccaactgct

SEQ ID NO: 2673 - DNA, 80 bp, Artificial Sequence
  Synthetic amplicon
ctcctgcaaatgcaaagagtgcaaatgcacctcctgcaagaagagctgctgctcctgctgccctgtgggctgtgccaagt

SEQ ID NO: 2674 - DNA, 71 bp, Artificial Sequence
  Synthetic amplicon
ggccaggatctgtggtggtacaattgactctggccttccgagaaggtaccatcaatgtccacgacgtggag

SEQ ID NO: 2675 - DNA, 75 bp, Artificial Sequence
  Synthetic amplicon
acgagaacgagggcatctatgtgcaggatgtcaagaccggaaaggtgcgcgctgtgattggaagcacctacatgc

SEQ ID NO: 2676 - DNA, 78 bp, Artificial Sequence
  Synthetic amplicon
gaaggaatgggaatcagtcatgagctaatcaccctggagatcagctcccgagatgtcccggatctgactctaatagac

SEQ ID NO: 2677 - DNA, 74 bp, Artificial Sequence
  Synthetic amplicon
gccgagatcgccaagatgttgccagggaggacagacaatgctgtgaagaatcactggaactctaccatcaaaag

SEQ ID NO: 2678 - DNA, 85 bp, Artificial Sequence
  Synthetic amplicon
cggtacttctcagggctaatatatacgtactctggcctcttctgcgtggtggtcaacccctataaacacctgcccatctactcgg

SEQ ID NO: 2679 - DNA, 69 bp, Artificial Sequence
  Synthetic amplicon
ccttcaccttcctcgtcaacaccaagcgccagtgtggagattgcaaattcaatgtctgcaagagctgct

SEQ ID NO: 2680 - DNA, 76 bp, Artificial Sequence
  Synthetic amplicon
gcatctacttgccagaaccaaattaacttacttccaagttctggctgcttgcaggtggaactccagctgcaaggga

SEQ ID NO: 2681 - DNA, 66 bp, Artificial Sequence
  Synthetic amplicon
gacaccttcatccgtcacatcgccctgctgggctttgagaagcgcttcgtacccagccagcactat

SEQ ID NO: 2682 - DNA, 70 bp, Artificial Sequence
  Synthetic amplicon
ctgaacccctctcctggtcaccgagaatcagtccccgtggagttccccctccacctcgccatcgtttcct

SEQ ID NO: 2683 - DNA, 72 bp, Artificial Sequence
  Synthetic amplicon
cagtcaaggtcagaggctgagcccgggttcctaccccacagtcattcagcagcagaatgccacgagccaaag

SEQ ID NO: 2684 - DNA, 73 bp, Artificial Sequence
  Synthetic amplicon
cagaccaaggagatggacctcagcgtggtgcggctcatgtttacagcttttcttccggatagcactggcagct

SEQ ID NO: 2685 - DNA, 68 bp, Artificial Sequence
  Synthetic amplicon
ctgccgggatggcttctatgaggctgagctctgcccggaccgctgcatccacagtttccagaacctgg

SEQ ID NO: 2686 - DNA, 74 bp, Artificial Sequence
  Synthetic amplicon
ccctgccataccagctcaccctgccctgtgactgcttgtaaagctaaggtagagctacagtgtgaatgtggacg

SEQ ID NO: 2687 - DNA, 66 bp, Artificial Sequence
  Synthetic amplicon
atgcttggggagaccaatccagcagattcaaagccaggcaccattcgtggggacttctgcattcag

SEQ ID NO: 2688 - DNA, 67 bp, Artificial Sequence
  Synthetic amplicon
cctagggcagggatggagagagagtctgggcatgaggagagggtctcgggatgtttggctggactag

SEQ ID NO: 2689 - DNA, 72 bp, Artificial Sequence
  Synthetic amplicon
cagccttgggaagtgagactagaagaggggagcagaaagggaccttgagtagacaaaggccacacacatcat

SEQ ID NO: 2690 - DNA, 67 bp, Artificial Sequence
  Synthetic amplicon
gggtccattatgactcccaaaagtttgaccagaggacccagggacaagcctacccctccagatgagc

SEQ ID NO: 2691 - DNA, 68 bp, Artificial Sequence
  Synthetic amplicon
atctccgcctcgctcatgggcacggtgatggcgaagcgagtgaaggcgacaatcctgtatggctccga

SEQ ID NO: 2692 - DNA, 76 bp, Artificial Sequence
  Synthetic amplicon
cgggtccaccagtttgaatggtcaatgcgagtggctgtcccggctgcagagcggcatggtgccgaaccaatacaac

SEQ ID NO: 2693 - DNA, 75 bp, Artificial Sequence
  Synthetic amplicon
cacttccctgctgggattatatcaacaaccagtgtgatgagctgtgcaacacggtcgagtgcctgtttgacaact

SEQ ID NO: 2694 - DNA, 67 bp, Artificial Sequence
  Synthetic amplicon
tgtggacgagtgtgctggccccgcaccctgtggccctcatggtatctgcaccaacctggcagggagt

SEQ ID NO: 2695 - DNA, 73 bp, Artificial Sequence
  Synthetic amplicon
ggctgtggctgaggctgtagcatctctgctggaggtgagacactctgggaactgatttgacctcgaatgctcc

SEQ ID NO: 2696 - DNA, 84 bp, Artificial Sequence
  Synthetic amplicon
aatgttgtccaggttctattgccaagaatgtgttgtccaaaatgcctgtttagtttttaaagatggaactccaccctttgcttg

SEQ ID NO: 2697 - DNA, 66 bp, Artificial Sequence
  Synthetic amplicon
gacacctgcttctgattccacaaggggctttttcctcaaccctgtggccgcctttgaagtgactca

SEQ ID NO: 2698 - DNA, 66 bp, Artificial Sequence
  Synthetic amplicon
acatctgcagctcccctgatgccttcagaaccctcatgctcctggccctggaagctggcttgtgtg

SEQ ID NO: 2699 - DNA, 70 bp, Artificial Sequence
  Synthetic amplicon
ggatcttccccactctgctcccttccattcccacccttccttctttaataagcaggagcgaaaaagacaa

SEQ ID NO: 2700 - DNA, 83 bp, Artificial Sequence
  Synthetic amplicon
cgagactctcctcatagtgaaaggtatgtgtcagccatgaccaccccggctcgtatgtcacctgtagatttccacacgccaag

SEQ ID NO: 2701 - DNA, 77 bp, Artificial Sequence
  Synthetic amplicon
actggtttccactcctgcttcagaagaagaaattccacgggtacttcaagttccagggtcaggacaccatcctggac

SEQ ID NO: 2702 - DNA, 71 bp, Artificial Sequence
  Synthetic amplicon
accaaggtggctgactgcatctgcctgatggccctagacaagccccaggctgtgcccgtggatgtccatat

SEQ ID NO: 2703 - DNA, 80 bp, Artificial Sequence
  Synthetic amplicon
caaccgaagttttcactccagttgtccccacagtagacacatatgatggccgaggtgatagtgtggtttatggactgagg

SEQ ID NO: 2704 - DNA, 65 bp, Artificial Sequence
  Synthetic amplicon
tggagactctcagggtcgaaaacggcggcagaccagcatgacagatttctaccactccaaacgcc

SEQ ID NO: 2705 - DNA, 66 bp, Artificial Sequence
  Synthetic amplicon
cggtggaccacgaagagttaacccgggacttggagaagcactgcagagacatggaagaggcgagcc

SEQ ID NO: 2706 - DNA, 68 bp, Artificial Sequence
  Synthetic amplicon
ctttgaacccttgcttgcaataggtgtgcgtcagaagcacccaggacttccatttgctttgtcccggg

SEQ ID NO: 2707 - DNA, 80 bp, Artificial Sequence
  Synthetic amplicon
tggctgattccattaacagtgaaattggaatcctttgcagtgccctccagaaaataaagtaaagccatggacagaatgtg

SEQ ID NO: 2708 - DNA, 81 bp, Artificial Sequence
  Synthetic amplicon
ccgcaacgtggttttctcaccctatggggtggcctcggtgttggccatgctccagctgacaacaggaggagaaacccagca

SEQ ID NO: 2709 - DNA, 70 bp, Artificial Sequence
  Synthetic amplicon
gagctgtgggttgttatggaatacttggctggaggctccttgacagatgtggtgacagaaacttgcatgg

SEQ ID NO: 2710 - DNA, 66 bp, Artificial Sequence
  Synthetic amplicon
gatcctcgaggtcaatggcattgaagtagccgggaagaccttggaccaagtgacggacatgatggt

SEQ ID NO: 2711 - DNA, 72 bp, Artificial Sequence
  Synthetic amplicon
gcaaagcctttccagaaaaataaaaatggttgaaaaggcaattctgctaccaatgactgtttaagcccagcc

SEQ ID NO: 2712 - DNA, 68 bp, Artificial Sequence
  Synthetic amplicon
ggtgaaatctgtgcactgtcaagctggagacacagttggagaaggggatctgctcgtggagctggaat

SEQ ID NO: 2713 - DNA, 66 bp, Artificial Sequence
  Synthetic amplicon
cttagcatggcccagcacccagcagccaaactgcccaagatcttccatgtcaactggttccggaag

SEQ ID NO: 2714 - DNA, 71 bp, Artificial Sequence
  Synthetic amplicon
gaaggtgttggaggcactcaaggacctcatcaacgaggcctgctgggatattagctccagcggtgtaaacc

SEQ ID NO: 2715 - DNA, 67 bp, Artificial Sequence
  Synthetic amplicon
accttgagtagcagaggccctcacaccttcctcagaatggacccccaggtgaaatggctccagcaac

SEQ ID NO: 2716 - DNA, 73 bp, Artificial Sequence
  Synthetic amplicon
gacaacgccaccttcacctgcagcttctccaacacatcggagagcttcgtgctaaactggtaccgcatgagcc

SEQ ID NO: 2717 - DNA, 73 bp, Artificial Sequence
  Synthetic amplicon
gcttcgtcttgctgtgagagagcgagatcatgacttagagagactgcgcgatgtcctctcctccaatgaagct

SEQ ID NO: 2718 - DNA, 67 bp, Artificial Sequence
  Synthetic amplicon
ttgttggtgtgccctggtgccgtggtggcggtcactccctctgctgccagtgtttggacagaaccca

SEQ ID NO: 2719 - DNA, 62 bp, Artificial Sequence
  Synthetic amplicon
actgaaggagacccttggagcctaggggcatcggcaggagagtgtgtgggcagggttattta

SEQ ID NO: 2720 - DNA, 79 bp, Artificial Sequence
  Synthetic amplicon
agttactaaaaaataccacgaggtccttcagttgagaccaaagaccggtgtcaggggattgcacaaatcactcaccgac

SEQ ID NO: 2721 - DNA, 74 bp, Artificial Sequence
  Synthetic amplicon
tatcgaggcaggtcataccatgaccggaagtcaaaagttgacctggataggctcaatgatgatgccaagcgtta

SEQ ID NO: 2722 - DNA, 72 bp, Artificial Sequence
  Synthetic amplicon
gggagtttccaagagatggactagtgcttggtcgggtcttggggtctggagcgtttgggaaggtggttgaag

SEQ ID NO: 2723 - DNA, 66 bp, Artificial Sequence
  Synthetic amplicon
ccagctctccttccagctacagatcaatgtccctgtccgagtgctggagctaagtgagagccaccc

SEQ ID NO: 2724 - DNA, 75 bp, Artificial Sequence
  Synthetic amplicon
aatgacctccaccttcaacccccgagaatgtaaactgtccaagcaagaagggcaaaactatggcttcttcctgcg

SEQ ID NO: 2725 - DNA, 68 bp, Artificial Sequence
  Synthetic amplicon
gagctgagagccttgagcatgcctgaccttgacaagctctgcagcgaggattactcagcagggccgag

SEQ ID NO: 2726 - DNA, 73 bp, Artificial Sequence
  Synthetic amplicon
gcagtgcctgtgtgtgaagaccacctcccaggtccgtcccaggcacatcaccagcctggaggtgatcaaggcc

SEQ ID NO: 2727 - DNA, 68 bp, Artificial Sequence
  Synthetic amplicon
agctgatgccgcatacattttcgaagagcccttcgacatcagggatctgcagtccaacgtggagcacc

SEQ ID NO: 2728 - DNA, 82 bp, Artificial Sequence
  Synthetic amplicon
tctatacgtcgatggtgactgcacaatggacatccggacaaagagtcaaggtggggagccaacatacaatgtggctgtcggc

SEQ ID NO: 2729 - DNA, 71 bp, Artificial Sequence
  Synthetic amplicon
gtggttttccctcggagccccctggctcgggacgtctgagaagatgccggtcatgaggctgttcccttgct

SEQ ID NO: 2730 - DNA, 98 bp, Artificial Sequence
  Synthetic amplicon
tgctacctggacagcccgttggtgcgcttcctcctgaaacgagctgtgtctgacttgagagtgactcactacttcttctggttactgaaggacggcct

SEQ ID NO: 2731 - DNA, 83 bp, Artificial Sequence
  Synthetic amplicon
ataccaatcaccgcacaaacccaggctatttgttaagtccagtcacagcacaaagaaacatatgcggagaaaatgctagtgtg

SEQ ID NO: 2732 - DNA, 67 bp, Artificial Sequence
  Synthetic amplicon
gtgattgaagagcatgccaattggtctgtatcccgagaagcaggatttagctattcccacgcaggac

SEQ ID NO: 2733 - DNA, 68 bp, Artificial Sequence
  Synthetic amplicon
ccctttccccaagtagaagaggctgagctggatttgtggtccaaggcccccgccagctgctacatcct

SEQ ID NO: 2734 - DNA, 67 bp, Artificial Sequence
  Synthetic amplicon
gatttgctgggaagtgctgtgaaatagataccagggccacgtgctacgaggaccagggcatcagcta

SEQ ID NO: 2735 - DNA, 76 bp, Artificial Sequence
  Synthetic amplicon
cccatggatgctcctctgaagagactttcctcattgactgccgaggccccatgaatcaatgtctggtagccaccgg

SEQ ID NO: 2736 - DNA, 77 bp, Artificial Sequence
  Synthetic amplicon
ggcaaaatttccaagaccatgtctggactggaatgccaggcctgggactctcagagcccacacgctcatggatacat

SEQ ID NO: 2737 - DNA, 84 bp, Artificial Sequence
  Synthetic amplicon
tgatgcttctctgaagttctgctacaacctctagatctgcagcttgccacatcagcttaaaatctgtcatcccatgcagacagg

SEQ ID NO: 2738 - DNA, 84 bp, Artificial Sequence
  Synthetic amplicon
cagggaggtggttgcaaatttctaaggtacaattgctctattgagtcaccacgaaaaggctggagcttcatgcatcctgggaga

SEQ ID NO: 2739 - DNA, 66 bp, Artificial Sequence
  Synthetic amplicon
agaacagactggcctgaggagcagcagttgctggtggctaatggtgtaacctgagatggccctctg

SEQ ID NO: 2740 - DNA, 66 bp, Artificial Sequence
  Synthetic amplicon
ccatctacacggtgaggcacccggagtggcatctcaactcggattactcctacggtttcgcctaca

SEQ ID NO: 2741 - DNA, 77 bp, Artificial Sequence
  Synthetic amplicon
acaagcaccatcccagtgatgttctggcaggatttgctcaaggagccctggtggcctgctgcatagttttcttcgtg

SEQ ID NO: 2742 - DNA, 72 bp, Artificial Sequence
  Synthetic amplicon
tgactttatggagcccaagtttgagtttgctgtgaagttcaatgcactggaattagatgacagcgacttggc

SEQ ID NO: 2743 - DNA, 82 bp, Artificial Sequence
  Synthetic amplicon
ttccttccctctcaatccactagctttcatgttgggcaaggaaaagttgaggaaggatggctgatggtgatggaaagctgtg

SEQ ID NO: 2744 - DNA, 78 bp, Artificial Sequence
  Synthetic amplicon
gcaatcatggaacttgacgatactctaaaatactctttcttgcagtttgacccagcacctcgtagaggcgagccacat

SEQ ID NO: 2745 - DNA, 67 bp, Artificial Sequence
  Synthetic amplicon
gaggaagaggaggcggtggctcctacatctgggcccgctttagggggcttgttcgcttctctccctg

SEQ ID NO: 2746 - DNA, 70 bp, Artificial Sequence
  Synthetic amplicon
caagcaatgcgtcatcaatgtccccagcctctgcggaatggatcacactgagaagagggggcggatttac

SEQ ID NO: 2747 - DNA, 67 bp, Artificial Sequence
  Synthetic amplicon
gacccagctccactcctgcttccagaccatggaccgcctgtactttgtgatggagtacgtgaatggg

SEQ ID NO: 2748 - DNA, 68 bp, Artificial Sequence
  Synthetic amplicon
ctgacacttgccgcagagaatccctttctcacccacctcatctgcaccttccagaccaaggaccacct

SEQ ID NO: 2749 - DNA, 68 bp, Artificial Sequence
  Synthetic amplicon
ctccacctatgagcgtctgtctctgtgggcttgggatgttaacaggagccaaaaggagggaaagtgtg

SEQ ID NO: 2750 - DNA, 79 bp, Artificial Sequence
  Synthetic amplicon
attggaaaaacctcgtcaccagagaaagcccaacatattttatagtggcccagcttctcctgcaagaccaagataccga

SEQ ID NO: 2751 - DNA, 74 bp, Artificial Sequence
  Synthetic amplicon
ctatgacaggcatgccaccccgaccacccgaggctgtgtctccaacaccggaggcgtcttcctcatggttggag

SEQ ID NO: 2752 - DNA, 67 bp, Artificial Sequence
  Synthetic amplicon
cttcagcgcatccactaccccgacttcctcgttcagatccagaggcccgtggtgaagaccagcatgg

SEQ ID NO: 2753 - DNA, 69 bp, Artificial Sequence
  Synthetic amplicon
cactgcaccaagattcaggtcattgacatttccatgatcttggccgaagcaatccgaaggacacacaat

SEQ ID NO: 2754 - DNA, 68 bp, Artificial Sequence
  Synthetic amplicon
gtacactctggcctccagctatgcctcctggatccaaagcaaggtgacagaactccagcctcgtgtgg

SEQ ID NO: 2755 - DNA, 67 bp, Artificial Sequence
  Synthetic amplicon
gccaaactgcaggatgaaagaacagtgcggaagatctgtgctttggatgacaacgtctgcatggcct

SEQ ID NO: 2756 - DNA, 66 bp, Artificial Sequence
  Synthetic amplicon
cagtggctatcggcctaatcttagccctgaagaggcctatgaccttggccgcagggctattgctta

SEQ ID NO: 2757 - DNA, 66 bp, Artificial Sequence
  Synthetic amplicon
ggggtgtcatctacctggtcactattacagctgccggtgtggaccatcgagtcatcttgggcaatg

SEQ ID NO: 2758 - DNA, 81 bp, Artificial Sequence
  Synthetic amplicon
tggctaagtgaagatgacaatcatgttgcagcaattcactgtaaagctggaaagggacgaactggtgtaatgatatgtgca

SEQ ID NO: 2759 - DNA, 66 bp, Artificial Sequence
  Synthetic amplicon
ccacactggcatctccctgaccttctccagggacagaagcaggagtaagtttctcatcccatgggc

SEQ ID NO: 2760 - DNA, 73 bp, Artificial Sequence
  Synthetic amplicon
cgaggtacaagctgagatcaagaaatcttggagccgctggacactggcactggacttcaagcgaaaggcacgc

SEQ ID NO: 2761 - DNA, 68 bp, Artificial Sequence
  Synthetic amplicon
gaccggtcgaatgataaggtgtacgagaatgtgacgggcctggtgaaagctgtcatcgagatgtccag

SEQ ID NO: 2762 - DNA, 74 bp, Artificial Sequence
  Synthetic amplicon
caagcccagccgacctaagtacagaccccctccgcaaaccaacctcctggctccaaagctgcagttccaggttc

SEQ ID NO: 2763 - DNA, 67 bp, Artificial Sequence
  Synthetic amplicon
ccttccagtccaaaaatcccgccaagagagccccagagcagaggaaaatccaaagtggagagagggg

SEQ ID NO: 2764 - DNA, 77 bp, Artificial Sequence
  Synthetic amplicon
ctccagctagcactaagcaacatctcgctgtggacgcctgtaaattactgagaaatgtgaaacgtgcaatcttgaaa

SEQ ID NO: 2765 - DNA, 68 bp, Artificial Sequence
  Synthetic amplicon
gatatgcggtgaggaacagcttgatgcacacagactcatccgccactttcactatacggtgtggccag

SEQ ID NO: 2766 - DNA, 74 bp, Artificial Sequence
  Synthetic amplicon
tggccgtcaatggaagagggcactcgggcttttggagatgttgttgtaaagatcaaccagcacaaaagatgtcc

SEQ ID NO: 2767 - DNA, 71 bp, Artificial Sequence
  Synthetic amplicon
ggacagcgacaaagacttgaaagccaccattagccatgtctcacccgatagcctttacctgttccgagtcc

SEQ ID NO: 2768 - DNA, 74 bp, Artificial Sequence
  Synthetic amplicon
ggctactctgatctatgttgataaggaaaatggagaaccaggcacccgtgtggttgctaaggatgggctgaagc

SEQ ID NO: 2769 - DNA, 81 bp, Artificial Sequence
  Synthetic amplicon
aaaccaagatgctgatggctgctggagacaaagatggggacggcaaaattggggttgacgaattctccactctggtggctg

SEQ ID NO: 2770 - DNA, 67 bp, Artificial Sequence
  Synthetic amplicon
gctgctcaagctgaacccgcactgggacggcgacaccatctactatgagaccaggaagatcgtgggt

SEQ ID NO: 2771 - DNA, 66 bp, Artificial Sequence
  Synthetic amplicon
tgttgtaaatgtctcagcccctcgttcttggtcctgtcccttggaacctttgtacgctttgctcaa

SEQ ID NO: 2772 - DNA, 66 bp, Artificial Sequence
  Synthetic amplicon
agactactcgggtcgaggtgagctttcagccaggcagatgcacttggccaggtttctgcggatgct

SEQ ID NO: 2773 - DNA, 73 bp, Artificial Sequence
  Synthetic amplicon
cgtcgtatgcgagagtctgtttccaggatgcctgttagttctcagcacagatattctacacctcacgccttca

SEQ ID NO: 2774 - DNA, 84 bp, Artificial Sequence
  Synthetic amplicon
ggtgtcagatataaatgtgcaaatgccttcttgctgtcctgtcggtctcagtacgttcactttatagctgctggcaatatcgaa

SEQ ID NO: 2775 - DNA, 78 bp, Artificial Sequence
  Synthetic amplicon
tgcctggacatcctgattcttagaatttgcaccaggtataccccagaacaagacaccatgactttctcagacggcctt

SEQ ID NO: 2776 - DNA, 75 bp, Artificial Sequence
  Synthetic amplicon
agggcacgtgaagtcattgaggccctgctgcgaaagttcttggtggtggatgacccccgcaagtttgcactcttt

SEQ ID NO: 2777 - DNA, 77 bp, Artificial Sequence
  Synthetic amplicon
cgaagcccttacaagtttcctagttcacccttacggattcctggagggaacatctatatttcacccctgaagagtcc

SEQ ID NO: 2778 - DNA, 66 bp, Artificial Sequence
  Synthetic amplicon
tggttttgaatcaccagggccgcccatcaggagatgcctttatccagatgaagtctgcggacagag

SEQ ID NO: 2779 - DNA, 83 bp, Artificial Sequence
  Synthetic amplicon
tgctaactcctgcacagccccgtcctcttcctttctgctagcctggctaaatctgctcattatttcagaggggaaacctagca

SEQ ID NO: 2780 - DNA, 71 bp, Artificial Sequence
  Synthetic amplicon
gcctgtgcagttcttgtgccccaacatcagcgtggcctacaggctcctggagggtgagggtctgcccttcc

SEQ ID NO: 2781 - DNA, 84 bp, Artificial Sequence
  Synthetic amplicon
tgccctgtaaagcagaagagatatataaagcatttgtgcattcagatgctgctaaacaaatcaatattgacttccgcactcgag

SEQ ID NO: 2782 - DNA, 79 bp, Artificial Sequence
  Synthetic amplicon
ttcaaacggaggctcctaaagaggtgaatattgaccacttcactaaggacatcacaatgaagaacctggtggaaccttc

SEQ ID NO: 2783 - DNA, 78 bp, Artificial Sequence
  Synthetic amplicon
gatgattgagaacagccttgcctgtcactgtcctagaacaccctggagtttagtgttctgtgtcagagtcttgggagc

SEQ ID NO: 2784 - DNA, 67 bp, Artificial Sequence
  Synthetic amplicon
aagcatgaacaggacttgaccatctttccaacccctggggaagacatttgcaactgacttggggagg

SEQ ID NO: 2785 - DNA, 68 bp, Artificial Sequence
  Synthetic amplicon
cccgttcggtctgaggaaggccgggacatggcgaaccggatcagtgcctttggctaccttgagtgctc

SEQ ID NO: 2786 - DNA, 67 bp, Artificial Sequence
  Synthetic amplicon
agtaccttcaagccggtcaaattcagccacagaacagcctggttcactgcacagttcccagggactt

SEQ ID NO: 2787 - DNA, 66 bp, Artificial Sequence
  Synthetic amplicon
tcggaattggacttgggaggcgcggtgaggagtcaggcttaaaacttgttggaggggagtaaccag

SEQ ID NO: 2788 - DNA, 73 bp, Artificial Sequence
  Synthetic amplicon
tgtgcacataggaatgagcttcagatgcagttggccagcaaagagagtgatattgagcaattgcgtgctaaac

SEQ ID NO: 2789 - DNA, 66 bp, Artificial Sequence
  Synthetic amplicon
gatccgagaccctcgctcccccatcaacgtggagagcttgctggatggcttaaattccttggtcct

SEQ ID NO: 2790 - DNA, 68 bp, Artificial Sequence
  Synthetic amplicon
caaggtgctcggtccttccgaggaagctaaggctgcgttggggtgaggccctcacttcatccggcgac

SEQ ID NO: 2791 - DNA, 67 bp, Artificial Sequence
  Synthetic amplicon
gttctggttgctggatttggtcgcaaaggtcatgctgttggtgatattcctggagtccgctttaagg

SEQ ID NO: 2792 - DNA, 74 bp, Artificial Sequence
  Synthetic amplicon
cttacggggaagaccatcaccctcgaggttgaaccctcggatacgatagaaaatgtaaaggccaagatccagga

SEQ ID NO: 2793 - DNA, 70 bp, Artificial Sequence
  Synthetic amplicon
gctcatggagctagtgcctctggacccggagaatggacagacctcaggggaagaagctggacttcagccg

SEQ ID NO: 2794 - DNA, 81 bp, Artificial Sequence
  Synthetic amplicon
gctcattatgaaaaacatcccaaactttaaaatgcgaaattattggttggtgtgaagaaagccagacaacttctgtttctt

SEQ ID NO: 2795 - DNA, 66 bp, Artificial Sequence
  Synthetic amplicon
gggctactggcagctacattgctgggactaatggcaattccaatggccttgtaccgatgctgagag

SEQ ID NO: 2796 - DNA, 71 bp, Artificial Sequence
  Synthetic amplicon
cagcgggattaaacagtcctttaaccagcacagccagttaaaagatgcagcctcactgcttcaacgcagat

SEQ ID NO: 2797 - DNA, 70 bp, Artificial Sequence
  Synthetic amplicon
aacagagacattgccaaccatattggatctgcttgctgtccaaaccagcaaactttcctgggcaaatcac

SEQ ID NO: 2798 - DNA, 70 bp, Artificial Sequence
  Synthetic amplicon
tggacaaggtgatgaaggagctagacgagaatggagacggggaggtggacttccaggagtatgtggtgct

SEQ ID NO: 2799 - DNA, 77 bp, Artificial Sequence
  Synthetic amplicon
acaccaaaatgccatctcaaatggaacacgccatggaaaccatgatgtttacatttcacaaattcgctggggataaa

SEQ ID NO: 2800 - DNA, 73 bp, Artificial Sequence
  Synthetic amplicon
tggctgtgctggtcactaccttccacaagtactcctgccaagagggcgacaagttcaagctgagtaaggggga

SEQ ID NO: 2801 - DNA, 72 bp, Artificial Sequence
  Synthetic amplicon
ctacagcacagatcagcaccatgaagcttctcacgggcctggttttctgctccttggtcctgagtgtcagca

SEQ ID NO: 2802 - DNA, 67 bp, Artificial Sequence
  Synthetic amplicon
gccttcctggagtacccgagtgctccctatgcctttccaagcatttctacttggggaattgggccac

SEQ ID NO: 2803 - DNA, 66 bp, Artificial Sequence
  Synthetic amplicon
atcaacatcctgtcgaggctgccagagactctgccatccctggaggaggacacgctgggcaacttc

SEQ ID NO: 2804 - DNA, 67 bp, Artificial Sequence
  Synthetic amplicon
gcagaactgaagatgggaagatttatcagcgtgcatttggtggacagagcctcaagtttggaaaggg

SEQ ID NO: 2805 - DNA, 66 bp, Artificial Sequence
  Synthetic amplicon
accagcacaagatggagcagcgacagatcagtttggagggctccgtgaagggcatccagaatgacc

SEQ ID NO: 2806 - DNA, 71 bp, Artificial Sequence
  Synthetic amplicon
acactggtctggcctgctacctacctgtgaagctcccactgagtccaacattcccttggtagctggacttt

SEQ ID NO: 2807 - DNA, 67 bp, Artificial Sequence
  Synthetic amplicon
ggtaccagcctcgacacaatgtcatgatcagcactgagtgggcagctcccaatgtcttacgagatgg

SEQ ID NO: 2808 - DNA, 67 bp, Artificial Sequence
  Synthetic amplicon
tgcaactgtgatgtggggtactatgggccccagtgtcagtttgtgattcagtgtgagcctttggagg

SEQ ID NO: 2809 - DNA, 83 bp, Artificial Sequence
  Synthetic amplicon
tggccactatcttcttcgtgtgcactgtggtgctggcggtccgcctctcccgcaagggccacatgtaccccgtgcgtaattac

SEQ ID NO: 2810 - DNA, 71 bp, Artificial Sequence
  Synthetic amplicon
gctccaggatgtgtttctgttgtcctcgcgggaccaccggaccccgctgctctatgccgtcttctccacgt

SEQ ID NO: 2811 - DNA, 66 bp, Artificial Sequence
  Synthetic amplicon
atggccattcctgttccagattctacccaactgggaaacggaggagccgaagacaagatgtgagac

SEQ ID NO: 2812 - DNA, 86 bp, Artificial Sequence
  Synthetic amplicon
cgcgagcccctcattatacactgggcagcctccccacagcgcatcgaggaatgcgtgctctcaggcaaggatgtcaacggcgagtg

SEQ ID NO: 2813 - DNA, 67 bp, Artificial Sequence
  Synthetic amplicon
ctcgaggacagctccaacatgagcctctggacccagaacatcaccgcctgtcctgtgcggaatgtga

SEQ ID NO: 2814 - DNA, 66 bp, Artificial Sequence
  Synthetic amplicon
cagcatggtagtggcaaagagaggtccagagtcctggcccttgatgcccagctcagtgccacaaag

SEQ ID NO: 2815 - DNA, 70 bp, Artificial Sequence
  Synthetic amplicon
gagagagccagtctgatccagaaggccaagctggcagagcaggccgaacgctatgaggacatggcagcct

SEQ ID NO: 2816 - DNA, 73 bp, Artificial Sequence
  Synthetic amplicon
tccgcaagacacctcctggagggcctcctgcagaaggacaggacaaagcggctcggggccaaggatgacttca

SEQ ID NO: 2817 - DNA, 68 bp, Artificial Sequence
  Synthetic amplicon
ctgtgccctctacaaccaggagagctgtgctcgtgtcctgctcttccgtggagctaacagggatgtcc

SEQ ID NO: 2818 - DNA, 71 bp, Artificial Sequence
  Synthetic amplicon
ccaacaccttcttggcttctgggacctgtgttcttgctgagcaccctctccggtttgggttgggataacag

SEQ ID NO: 2819 - DNA, 66 bp, Artificial Sequence
  Synthetic amplicon
ccgcatcttctgctcttgtcccattggtgagaatagccccctcctcagtgggcagcaggtctgagt

SEQ ID NO: 2820 - DNA, 66 bp, Artificial Sequence
  Synthetic amplicon
agaggctgaatatgcaggacagttggcagaactgaggcagagattggaccatgctgaggccgatag

SEQ ID NO: 2821 - DNA, 66 bp, Artificial Sequence
  Synthetic amplicon
cttgccctccaacaaggtctgcccccagtacttcctcgacaccaacttcctcttcctcagtgggct

SEQ ID NO: 2822 - DNA, 68 bp, Artificial Sequence
  Synthetic amplicon
atgcgacccacgtctacatgtacgtgttcatcctggcgggggccgaggtgctcacctcctccctgatt

SEQ ID NO: 2823 - DNA, 66 bp, Artificial Sequence
  Synthetic amplicon
atcgtcagcgagtttgaccttgtctgtgtcaatgcgtggatgctggacctcacccaagccatcctg

SEQ ID NO: 2824 - DNA, 68 bp, Artificial Sequence
  Synthetic amplicon
tccgccacctcttcctctgcctctccatgctgtggtttgccactagctttgcatactatgggctggtc

SEQ ID NO: 2825 - DNA, 67 bp, Artificial Sequence
  Synthetic amplicon
gcctgagtctcctgtgcccacatcccaggcttcaccctgaatggttccatgcctgagggtggagact

SEQ ID NO: 2826 - DNA, 66 bp, Artificial Sequence
  Synthetic amplicon
gctgagacccactgacctgcagacctcatagtgggtgcccaggatgttgtcctacggagagaggct

SEQ ID NO: 2827 - DNA, 70 bp, Artificial Sequence
  Synthetic amplicon
gcgcagaggccagttaaagtagatcacctcctcgaacccactccggttccccgcaacccacagctcagct

SEQ ID NO: 2828 - DNA, 67 bp, Artificial Sequence
  Synthetic amplicon
cttcgagatctccctctggatccttctggcctgcctcatgaagataggtttccatgtgatccccact

SEQ ID NO: 2829 - DNA, 67 bp, Artificial Sequence
  Synthetic amplicon
tttaccgatgcacctgtccatatggtttcaaggggcaggactgtgatgtcccaattcatgcctgcat

SEQ ID NO: 2830 - DNA, 69 bp, Artificial Sequence
  Synthetic amplicon
cccaatcggaagcctaactacagcgagctgcaggactctaatccagagtttaccttccagcagccctac

SEQ ID NO: 2831 - DNA, 71 bp, Artificial Sequence
  Synthetic amplicon
gaggaaaagtcagggccggggctccagctgcagtagttcggagaccagtgatgatgattctgaaagccggc

SEQ ID NO: 2832 - DNA, 70 bp, Artificial Sequence
  Synthetic amplicon
tgaagagaggcatgttggagacttgggcaatgtgactgctgacaaagatggtgtggccgatgtgtctatt

SEQ ID NO: 2833 - DNA, 69 bp, Artificial Sequence
  Synthetic amplicon
tcaagagtctcagcagccaaccagtcaagcccaaattgtgcaaggtattacaccacagacaatccatgg

SEQ ID NO: 2834 - DNA, 73 bp, Artificial Sequence
  Synthetic amplicon
tcttccctgtacactggcagttcggccagctggaccagcaccccattgacgggtacctctcccacaccgagct

SEQ ID NO: 2835 - DNA, 67 bp, Artificial Sequence
  Synthetic amplicon
ggcacagtgcaagtgatgactacttcatcccaagccaggcctttctggaggccgagagagctcaatc

SEQ ID NO: 2836 - DNA, 66 bp, Artificial Sequence
  Synthetic amplicon
cctgagttgttcacagggcttagagctcctgccagagggctgttactctttggtccacctgggaat

SEQ ID NO: 2837 - DNA, 67 bp, Artificial Sequence
  Synthetic amplicon
ggcagcttccttgaaccattatgctggctatgagcaggtcaccaatgaagacctcctgaccaactgc

SEQ ID NO: 2838 - DNA, 77 bp, Artificial Sequence
  Synthetic amplicon
cagaccagtccctggtcataggtctgaaagggcaatccggacccagcccaagcaactgattgtggatgacttgaagg

SEQ ID NO: 2839 - DNA, 69 bp, Artificial Sequence
  Synthetic amplicon
ggacccgtctacaggtgaactccagtccctacagatgccagaatccgaagggccaagctctctggaccc

SEQ ID NO: 2840 - DNA, 81 bp, Artificial Sequence
  Synthetic amplicon
gggctcagctttcagaagtgctgagttggcagttttcttctgtcaccaaaagaggtctcaatgtggaccagctgaacatgt

SEQ ID NO: 2841 - DNA, 70 bp, Artificial Sequence
  Synthetic amplicon
tcacatgccactttggtgtttcataatctcctgggagagattgaccagcagtatagccgcttcctgcaag

SEQ ID NO: 2842 - DNA, 77 bp, Artificial Sequence
  Synthetic amplicon
gaggcgctcaacatgaaattcaaggccgaagtgcagagcaaccggggcctgaccaaggagaacctcgtgttcctggc

SEQ ID NO: 2843 - DNA, 74 bp, Artificial Sequence
  Synthetic amplicon
ccagtggtggtgatcgttcatggcagccaggacaacaatgcgacggccactgttctctgggacaatgcttttgc

SEQ ID NO: 2844 - DNA, 67 bp, Artificial Sequence
  Synthetic amplicon
aaggaggccatcacccacagcgtgcaggttcagtgtgagcagaactggggaagcctgtgctccatct

SEQ ID NO: 2845 - DNA, 66 bp, Artificial Sequence
  Synthetic amplicon
ggactcggagacgctgtgcaggagggccgtcaagatcctcaagaagaagaagttgcgaaggatccc

SEQ ID NO: 2846 - DNA, 69 bp, Artificial Sequence
  Synthetic amplicon
catcttccaggaggaccactctctgtggcaccctggactacctgccccctgaaatgattgaaggtcgga

SEQ ID NO: 2847 - DNA, 66 bp, Artificial Sequence
  Synthetic amplicon
gagccatcttcctgcaactttacctctttccctcagatggggagccatgactgggttgcacctcag

SEQ ID NO: 2848 - DNA, 90 bp, Artificial Sequence
  Synthetic amplicon
cctggaggctgcaacatacctcaatcctgtcccaggccggatcctcctgaagcccttttcgcagcactgctatcctccaaagccattgta

SEQ ID NO: 2849 - DNA, 66 bp, Artificial Sequence
  Synthetic amplicon
ccaagcctgtagtgtccttcattgctggtttaactgctcctcctgggagaagaatgggtcatgccg

SEQ ID NO: 2850 - DNA, 67 bp, Artificial Sequence
  Synthetic amplicon
gggacccaaagcatgaaattcggaaggtgatgcagttcatgggaaagaaggtggatgaaacagtgct

SEQ ID NO: 2851 - DNA, 80 bp, Artificial Sequence
  Synthetic amplicon
tgttttgattcccgggcttaccaggtgagaagtgagggaggaagaaggcagtgtcccttttgctagagctgacagctttg

SEQ ID NO: 2852 - DNA, 80 bp, Artificial Sequence
  Synthetic amplicon
atcaccaaccggagaaagtcggggaagtacaagaaggtggagatcaaggaactgggggagttgagaaaggaaccgagctt

SEQ ID NO: 2853 - DNA, 73 bp, Artificial Sequence
  Synthetic amplicon
gatggagcaggtggctcagttcctgaaggcggctgaggactatggggtcatcaagactgacatgttccagact

SEQ ID NO: 2854 - DNA, 72 bp, Artificial Sequence
  Synthetic amplicon
gtatgctgctgaaagtgggaatcctctacattggtgggcagctggtgaccagtggggctgtaagcagtggga

SEQ ID NO: 2855 - DNA, 67 bp, Artificial Sequence
  Synthetic amplicon
cacaccctggaatgggagacgcatcgaatcacatgggacagatgtaaaagggtccaagttgccacat

SEQ ID NO: 2856 - DNA, 66 bp, Artificial Sequence
  Synthetic amplicon
agcgaggatgaggacgtgatccccgctacacagtgcttgactcctggcatcagaaccaatgtggtg

SEQ ID NO: 2857 - DNA, 76 bp, Artificial Sequence
  Synthetic amplicon
acttcggtgctacttaacaacttacatcccagggagcagtacgtggtccgagctagagtcaacaccaaggcccagg

SEQ ID NO: 2858 - DNA, 85 bp, Artificial Sequence
  Synthetic amplicon
gacatggagaacaagctgtttgcggggattcggcgggacgggctgctcctgcgtttggtggatgatttcttgttggtgacacctc

SEQ ID NO: 2859 - DNA, 67 bp, Artificial Sequence
  Synthetic amplicon
cgtgtgacgtgcgagagacgcgatggacgcgccttgctcttactgtgcaggtcctgagagcgtgtgg

SEQ ID NO: 2860 - DNA, 68 bp, Artificial Sequence
  Synthetic amplicon
catgcctcaccagatggacgaggtgcagaatgtcgacgaccagcacctgttgctgcacgatcagacag

SEQ ID NO: 2861 - DNA, 69 bp, Artificial Sequence
  Synthetic amplicon
ccgaatggtttccaggtggataattatggaacccagctcaatgctgtgaataactccctgactccgcaa

SEQ ID NO: 2862 - DNA, 83 bp, Artificial Sequence
  Synthetic amplicon
ggtgtgccacagaccttcctacttggcctgtaatcacctgtgcagccttttgtgggccttcaaaactctgtcaagaactccgt

SEQ ID NO: 2863 - DNA, 80 bp, Artificial Sequence
  Synthetic amplicon
ctgtatttaaggacacccgtgccccaagcccacctggggccccattaaagatggagagaggactgcggatctctgtgtca

SEQ ID NO: 2864 - DNA, 75 bp, Artificial Sequence
  Synthetic amplicon
accagtcccccagaagactatcctgagcccgaggaagtccccccggaggtgatttccatctacaacagcaccagg

SEQ ID NO: 2865 - DNA, 67 bp, Artificial Sequence
  Synthetic amplicon
gctacgagtgctgtcctggatatgaaaaggtccctggggagaagggctgtccagcagccctaccact

SEQ ID NO: 2866 - DNA, 67 bp, Artificial Sequence
  Synthetic amplicon
gtcatcacctggccttggtcctgtggaactggcagctgtcattgctggaccagtgtgcttcgtctgc

SEQ ID NO: 2867 - DNA, 66 bp, Artificial Sequence
  Synthetic amplicon
aacaccaatgggttccatctttctgggctcctgattgctcaagcacagtttggcctgatgaagagg

SEQ ID NO: 2868 - DNA, 68 bp, Artificial Sequence
  Synthetic amplicon
agatctgcgacggactgcggggccacctaatgacagtgcgctcctcggtggctgccgatgtcatttcc

SEQ ID NO: 2869 - DNA, 85 bp, Artificial Sequence
  Synthetic amplicon
catccgcaaagtgactgaagagaacaaagagttggccaatgagctgaggcggcctcccctatgctatcacaacggagttcagtac

SEQ ID NO: 2870 - DNA, 76 bp, Artificial Sequence
  Synthetic amplicon
tccctgcggtcccagatagcctgaatcctgcccggagtggaagctgaagcctgcacagtgtccaccctgttcccac

SEQ ID NO: 2871 - DNA, 69 bp, Artificial Sequence
  Synthetic amplicon
tcaccctctgtgacttcatcgtgccctgggacaccctgagcaccacccagaagaagagcctgaaccaca

SEQ ID NO: 2872 - DNA, 67 bp, Artificial Sequence
  Synthetic amplicon
ctacctgccttgctttgtgacttccaagaacgagtgtctctggaccgacatgctctccaatttcggt

SEQ ID NO: 2873 - DNA, 84 bp, Artificial Sequence
  Synthetic amplicon
gccgggaagaccgtaattgtggctgcactggatgggaccttccagaggaagccatttggggccatcctgaacctggtgccgctg

SEQ ID NO: 2874 - DNA, 71 bp, Artificial Sequence
  Synthetic amplicon
ggttgggccacctagaagtacttgacctgggccttaatgaaattgggcaagaactcacaggccaggaatgg

SEQ ID NO: 2875 - DNA, 75 bp, Artificial Sequence
  Synthetic amplicon
ccctgaaagaatgttgtggctgctcttttttctggtgactgccattcatgctgaactctgtcaaccaggtgcaga

SEQ ID NO: 2876 - DNA, 71 bp, Artificial Sequence
  Synthetic amplicon
ggattccactgttagagcccttaccgcctgcttatcctacccaatgactacattggctgttggttatttgc

SEQ ID NO: 2877 - DNA, 68 bp, Artificial Sequence
  Synthetic amplicon
gaaatcgccagcttcgataaggccaagctgaagaaaacggagacgcaggagaagaacaccctgccgac

SEQ ID NO: 2878 - DNA, 69 bp, Artificial Sequence
  Synthetic amplicon
ggagaagggtgaccgactcagcgctgagatcaatcggcccgactatctcgactttgccgagtctgggca

SEQ ID NO: 2879 - DNA, 68 bp, Artificial Sequence
  Synthetic amplicon
atcgtcttggctgagaaagggaaaagacacacaagtcgcgtgggttggagaagccagagccattccac

SEQ ID NO: 2880 - DNA, 67 bp, Artificial Sequence
  Synthetic amplicon
aggagtgaaagatgggatgcctattgctacaacccacacgcaaaggagtgtggtggcgtctttacag

SEQ ID NO: 2881 - DNA, 67 bp, Artificial Sequence
  Synthetic amplicon
ggagtttgaccagagatgcaaggggtgaaggagcgcttcctaccgttagggaactctggggacagag

SEQ ID NO: 2882 - DNA, 66 bp, Artificial Sequence
  Synthetic amplicon
cctctcgcttctggtggtctgtgaactgagtccctgggatgccttttagggcagagattcctgagc

SEQ ID NO: 2883 - DNA, 67 bp, Artificial Sequence
  Synthetic amplicon
tggcgaccaagacaccttgaagggcctaatgcacgcactaaagcactcaaagacgtaccactttccc

SEQ ID NO: 2884 - DNA, 71 bp, Artificial Sequence
  Synthetic amplicon
actgccctgagcccaaatgggggagtgagaggccatagctgtctggcatgggcctctccaccgtgcctgac

SEQ ID NO: 2885 - DNA, 68 bp, Artificial Sequence
  Synthetic amplicon
taggccaggagttcccaaatgtgaggggcgagaaacaagacaagctcctcccttgagaattccctgtg

SEQ ID NO: 2886 - DNA, 80 bp, Artificial Sequence
  Synthetic amplicon
cctacgccatgggacatctaattcagaggaagaaggtccatgtctttggggatgaattgagtctggtgactttgtttcga

SEQ ID NO: 2887 - DNA, 67 bp, Artificial Sequence
  Synthetic amplicon
ccaacctcactgggacacttttgccttcccgaaacactgatgagaccttctttggagtgcagtgggt

SEQ ID NO: 2888 - DNA, 66 bp, Artificial Sequence
  Synthetic amplicon
catgtcagaaagggccgatcgggaacgggctcaaagtaggattcaagaactggaggaaaaggtcgc

SEQ ID NO: 2889 - DNA, 72 bp, Artificial Sequence
  Synthetic amplicon
aatccaagggggagagtgatgacttccatatggactttgactcagctgtggctcctcgggcaaaatctgtac

SEQ ID NO: 2890 - DNA, 66 bp, Artificial Sequence
  Synthetic amplicon
tgtggacatcttcccctcagacttccctactgagccaccttctctgccacgaaccggtcgggctag

SEQ ID NO: 2891 - DNA, 82 bp, Artificial Sequence
  Synthetic amplicon
ctatatgcagccagagatgtgacagccaccgtggacagcctgccactcatcacagcctccattctcagtaagaaactcgtgg

SEQ ID NO: 2892 - DNA, 73 bp, Artificial Sequence
  Synthetic amplicon
cttcacagtgctcctgcagtctctctgtgtggctgtaacttacgtgtactttaccaacgagctgaagcagatg

SEQ ID NO: 2893 - DNA, 65 bp, Artificial Sequence
  Synthetic amplicon
gcctcggtgtgcctttcaacatcgccagctacgccctgctcacgtacatgattgcgcacatcacg

SEQ ID NO: 2894 - DNA, 66 bp, Artificial Sequence
  Synthetic amplicon
tcaccaaatctcagcccgctttcctcatcgttcagccgatgtcaccaccagcccttatgctgacac

SEQ ID NO: 2895 - DNA, 69 bp, Artificial Sequence
  Synthetic amplicon
cacagtggcctctttctcctccctgtaccagtccagctgccaaggacagctgcacaggagcgtttcctg

SEQ ID NO: 2896 - DNA, 67 bp, Artificial Sequence
  Synthetic amplicon
atcactggggtgatcctgctggctgttggagtctggggcaaacttactctgggcacctatatctccc

SEQ ID NO: 2897 - DNA, 83 bp, Artificial Sequence
  Synthetic amplicon
cagaaatctctgcaggcaagttgctccagagcatattgcaggacaagcctgtaacgaatagttaaattcacggcatctggatt

SEQ ID NO: 2898 - DNA, 73 bp, Artificial Sequence
  Synthetic amplicon
cgaggacgaggcttaaaaacttctcagatcaatcgtgcatccttagtgaacttctgttgtcctcaagcatggt

SEQ ID NO: 2899 - DNA, 68 bp, Artificial Sequence
  Synthetic amplicon
caccaagaacgggcagaagcgggccaagctgaggcgagtgcataagaatctgattcctcagggcatcg

SEQ ID NO: 2900 - DNA, 68 bp, Artificial Sequence
  Synthetic amplicon
ggaggagctaaatgcctcaggccggtgcactctgcccattgatgagtccaacaccatccacttgaagg

SEQ ID NO: 2901 - DNA, 68 bp, Artificial Sequence
  Synthetic amplicon
gccagaacggctcagtctggggcccttcgtgatgtctctgaggagctgagccgccaactggaagacat

SEQ ID NO: 2902 - DNA, 522 bp, Artificial Sequence
  Synthetic amplicon
gagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaagtggagcccagtgacaccatcgaaaatgtgaaggccaagatccaagataaagaaggcatccctcccgaccagcagaggctcatctttgcaggcaagcagctggaagatggccgcactctttctgactacaacatccagaaggagtcgaccctgcacctggtcctgcgcctgaggggtggctgttaattcttcagtcatggcattcgc

SEQ ID NO: 2903 - DNA, 76 bp, Artificial Sequence
  Synthetic amplicon
gaatgcacgctggaactttatccaccacaggttaattttcccatgtgcaccattgcatctatgcccaggctaccag

SEQ ID NO: 2904 - DNA, 67 bp, Artificial Sequence
  Synthetic amplicon
tgtctggcgataaagggatttctgccttccctgaatcagacaaccttttcaaatgggtagggaccat

SEQ ID NO: 2905 - DNA, 67 bp, Artificial Sequence
  Synthetic amplicon
tgttctcaaattgccaccaaaaggtgcttggagaccatccctcaacatcgcaactgtgttgacctct

SEQ ID NO: 2906 - DNA, 73 bp, Artificial Sequence
  Synthetic amplicon
ggcaactgacaaacagccttatagcaagctcccaggtgtctctcttctgaaaccactgaaaggggtagatcct

SEQ ID NO: 2907 - DNA, 66 bp, Artificial Sequence
  Synthetic amplicon
gcgtggacctggatgagtgcgccattcctggagctcacaactgctccgccaacagcagctgcgtaa

SEQ ID NO: 2908 - DNA, 70 bp, Artificial Sequence
  Synthetic amplicon
gtggatgtgccctgaaggacaagccaggcgtctacacgagagtctcacacttcttaccctggatccgcag

SEQ ID NO: 2909 - DNA, 70 bp, Artificial Sequence
  Synthetic amplicon
aagctgtgatggccaagctttgccctcccaggaccctgaggttgctttatctctcagttgtggccattcc

SEQ ID NO: 2910 - DNA, 89 bp, Artificial Sequence
  Synthetic amplicon
tggcttcaggagctgaataccctcccaggcacacacaggtgggacacaaataagggttttggaaccactattttctcatcacgacagca

SEQ ID NO: 2911 - DNA, 69 bp, Artificial Sequence
  Synthetic amplicon
cctgctacacagccaacaagaccacccactgtggaagacaaagaggcctttggacctcaggcgctttct

SEQ ID NO: 2912 - DNA, 67 bp, Artificial Sequence
  Synthetic amplicon
gccctggatttcagaaagagccaagtctggatctgggaccctttccttccttccctggcttgtaact

SEQ ID NO: 2913 - DNA, 71 bp, Artificial Sequence
  Synthetic amplicon
ctgctgtcttgggtgcattggagccttgccttgctgctctacctccaccatgccaagtggtcccaggctgc

SEQ ID NO: 2914 - DNA, 71 bp, Artificial Sequence
  Synthetic amplicon
tgacgatggcctggagtgtgtgcccactgggcagcaccaagtccggatgcagatcctcatgatccggtacc

SEQ ID NO: 2915 - DNA, 67 bp, Artificial Sequence
  Synthetic amplicon
cggttggtgacttgtctgcctcctgctttgggaagactgaggcatccgtgaggcagggacaagtctt

SEQ ID NO: 2916 - DNA, 72 bp, Artificial Sequence
  Synthetic amplicon
tgcccttaaaggaaccaatgagtccctggaacgccagatgcgtgaaatggaagagaactttgccgttgaagc

SEQ ID NO: 2917 - DNA, 70 bp, Artificial Sequence
  Synthetic amplicon
acagtggtctgggcatcccaagttgaccagggagccaacttctcggaagtctccaataccagctttgagc

SEQ ID NO: 2918 - DNA, 67 bp, Artificial Sequence
  Synthetic amplicon
agtcaatcttcgcacacggcgagtggacactgtggaccctccctacccacgctccatcgctcagtac

SEQ ID NO: 2919 - DNA, 66 bp, Artificial Sequence
  Synthetic amplicon
tgaagcacagtgccctctccgtcgagctgcacagtgacatggaggtgacggtgaatgggagactgg

SEQ ID NO: 2920 - DNA, 67 bp, Artificial Sequence
  Synthetic amplicon
aacaagctgagtgcccaggcgggtgccgaaatggaggcttttgtaatgaaagacgcatctgcgagtg

SEQ ID NO: 2921 - DNA, 75 bp, Artificial Sequence
  Synthetic amplicon
agaggcatccatgaacttcacacttgcgggctgcatcagcacacgctcctatcaacccaagtactgtggagtttg

SEQ ID NO: 2922 - DNA, 66 bp, Artificial Sequence
  Synthetic amplicon
tgtacggtcggcatctgagaccagtgagaaacgccccttcatgtgtgcttacccaggctgcaataa

SEQ ID NO: 2923 - DNA, 74 bp, Artificial Sequence
  Synthetic amplicon
atcgcagctggtgggtgtacacactgctgtttaccttggcgaggcctttcaccaagtccatgcaacagggagct

SEQ ID NO: 2924 - DNA, 66 bp, Artificial Sequence
  Synthetic amplicon
tggtggcagacatcccttcctggccagatacaaggttggcttcatgaagactgggacagttgtggc

SEQ ID NO: 2925 - DNA, 77 bp, Artificial Sequence
  Synthetic amplicon
gcagttggaagacacaggaaagtatccccaaattgcagatttatcaacggcttttatcttgaaaatagtgccacgca

SEQ ID NO: 2926 - DNA, 72 bp, Artificial Sequence
  Synthetic amplicon
caccctgcactgaacataccccaagagcccctgctggcccattgcctagaaacctttgcattcatcctcctt

SEQ ID NO: 2927 - DNA, 76 bp, Artificial Sequence
  Synthetic amplicon
agactgtggagtttgatgttgttgaaggagaaaagggtgcggaggcagcaaatgttacaggtcctggtggtgttcc

SEQ ID NO: 2928 - DNA, 67 bp, Artificial Sequence
  Synthetic amplicon
gagtacgaccagttagcggccaagactggcctggtccgaactgagattgtgcgttggttcaaggaga

What is claimed is:

1. A method for determining a likelihood of recurrence of renal cell carcinoma for a human patient comprising:
   (a) measuring, in a renal cell carcinoma sample obtained from the human patient a level of an RNA transcript of PPAP2B, wherein the measuring is performed using polymerase chain reaction (PCR) with a polynucleotide comprising the sequence of SEQ ID NO: 545 and a polynucleotide comprising the sequence of SEQ ID NO: 1277 as PCR primers and a polynucleotide comprising the sequence of SEQ ID NO: 2009 as a probe to detect PPAP2B polynucleotides produced by PCR;
   (b) normalizing the level of the RNA transcript of PPAP2B against at least one reference RNA transcript from the sample to obtain a normalized PPAP2B expression level;
   (c) comparing the normalized PPAP2B expression level to a normalized PPAP2B expression level obtained from a renal cell carcinoma sample from a human patient with recurrent renal cell carcinoma; and
   (d) determining a decreased likelihood for recurrence of renal cell carcinoma for the human patient if the normalized PPAP2B expression level is increased compared to the normalized PPAP2B expression level obtained from the renal cancer sample from the human patient with recurrent renal cell carcinoma.

2. The method of claim 1, further comprising generating a report based on the normalized PPAP2B expression level.

3. The method of claim 1, further comprising calculating a score estimating the likelihood that the patient will have a recurrence of renal cell carcinoma based on the normalized PPAP2B expression level.

4. The method of claim 3, further comprising generating a report based on the score.

5. The method of claim 1, further comprising wherein the renal cell carcinoma sample is a paraffin-embedded sample.

6. The method of claim 1, wherein the renal cell carcinoma sample is a frozen sample.

7. A method for determining presence of necrosis in a renal cell carcinoma sample obtained from a human patient, comprising:
   (a) measuring, in a renal cell carcinoma sample obtained from the human patient a level of an RNA transcript of PPAP2B, wherein the measuring is performed using polymerase chain reaction (PCR) with a polynucleotide comprising the sequence of SEQ ID NO: 545 and a polynucleotide comprising the sequence of SEQ ID NO: 1277 as PCR primers and a polynucleotide comprising the sequence of SEQ ID NO: 2009 as a probe to detect PPAP2B polynucleotides produced by PCR;
   (b) normalizing the level of the RNA transcript of PPAP2B against at least one reference RNA transcript from the sample to obtain a normalized PPAP2B expression level;
   (c) comparing the normalized PPAP2B expression level to a normalized PPAP2B expression level obtained from a renal cell carcinoma sample without necrosis; and (d) determining the presence of necrosis in the renal cell carcinoma sample if the normalized PPAP2B expression level is decreased compared to the normalized PPAP2B expression level obtained from the renal cancer sample without necrosis.

8. The method of claim 7, wherein the renal cell carcinoma sample is a paraffin-embedded sample.

9. The method of claim 7, wherein the renal cell carcinoma sample is a frozen sample.

10. A method for determining a likelihood of recurrence of renal cell carcinoma for a human patient, comprising:
   extracting RNA from a renal cell carcinoma sample obtained from the human patient;
   reverse transcribing an RNA transcript of PPAP2B to produce a cDNA of PPAP2B;
   amplifying, using polymerase chain reaction (PCR), the cDNA of PPAP2B to produce an amplicon of the RNA transcript of PPAP2B, wherein the PCR uses a polynucleotide comprising the sequence of SEQ ID NO:545 and a polynucleotide comprising the sequence of SEQ ID NO: 1277 as primers;
   assaying a level of the amplicon of the RNA transcript of PPAP2B with a polynucleotide comprising the sequence of SEQ ID NO: 2009;
   normalizing the amplicon level of the RNA transcript of PPAP2B against an amplicon level of at least one reference RNA transcript in the renal cell carcinoma sample to provide normalized amplicon level of PPAP2B,
   comparing the normalized amplicon level of PPAP2B from the human patient to a normalized amplicon level of PPAP2B from a renal cell carcinoma sample from a human patient with recurrent renal cell carcinoma; and
   determining that the human patient has a decreased likelihood of recurrence of renal cell carcinoma if the normalized amplicon level of PPAP2B from the human patient is increased compared to the normalized PPAP2B expression level obtained from the renal cell carcinoma sample from the human patient with recurrent renal cell carcinoma.

11. The method of claim 10, further comprising wherein the renal cell carcinoma sample is a paraffin-embedded sample.

12. The method of claim 10, wherein the renal cell carcinoma sample is a frozen sample.

* * * * *

UNITED STATES PATENT AND TRADEMARK OFFICE
CERTIFICATE OF CORRECTION

| | | |
|---|---|---|
| PATENT NO. | : 9,551,034 B2 | Page 1 of 1 |
| APPLICATION NO. | : 12/987023 | |
| DATED | : January 24, 2017 | |
| INVENTOR(S) | : Cowens et al. | |

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 77 days.

Signed and Sealed this
Tenth Day of April, 2018

Andrei Iancu
*Director of the United States Patent and Trademark Office*